United States Patent 12,508,308 (INFLUENZA mRNA VACCINES) - sequence listing, part 2

SEQ ID NO: 973 - protein, 565 aa, Artificial Sequence
  hemagglutinin__InfluenzaA__ABG26945
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEASGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 974 - protein, 566 aa, Artificial Sequence
  hemagglutinin__InfluenzaA__ABG26956
MKTIIALSYILCLVFAQKLPGNDNRTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSKLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 975 - protein, 565 aa, Artificial Sequence
  hemagglutinin__InfluenzaA__ABG37120
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGESSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 976 - protein, 566 aa, Artificial Sequence
  hemagglutinin__InfluenzaA__ABG37131
MKTIIALSYISCLVFAQKLPGNDNSTATLCLGHHAVPNGTLVKTITNDQIEVTNATELVQSSSTGRICDGPHQILDGKNCTLIDALLGDPHCDGFQNKEWDLFVERSKAYSNCYPYDVPDYASLRSLVASSGTLEFTNESFNWTGVAQNGTSYACKRGSVKSFFSRLNWLHKLEYKYPALNVTMPNNDKFDKLYIWGVHHPSTDSDQTSLYVQSSGRVTVSTKRSQQTVTPNIGSRPWVRGISSRISIYWTIVKPGDILLINSTGNLIAPRGYFKIRRGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 977 - protein, 566 aa, Artificial Sequence; identical to SEQ ID NO: 783
  hemagglutinin__InfluenzaA__ABG37142

SEQ ID NO: 978 - protein, 566 aa, Artificial Sequence
  hemagglutinin__InfluenzaA__ABG37164
MKTIIALSYILCLVFAQKLPGNDNSTATLCLGHHAVPNGTLVKTITNDQIEVTNATELVQSSSTGRICDSPHRILDGKNCTLIDALLGDPHCDDFQNKEWDLFVERSKAYSNCYPYDVPDYASLRSLVASSGTLEFTKEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 979 - protein, 566 aa, Artificial Sequence
  hemagglutinin__InfluenzaA__ABG37175
MKTIIALSYILCQVFAKKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYSCKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 980 - protein, 566 aa, Artificial Sequence
  hemagglutinin__InfluenzaA__ABG37186
MKTIIALSYILCQVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLISSTGNLIAPRGYFKIRNGKSSIMRSDAPIDNCNSECITPNGSIPNDKPFQNVNRVTYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYKDEALNNRFQIKGVVLKSGYKDWILWISFAISCFLLCVVLLGFIMWACQKGNIRCNICI

SEQ ID NO: 981 - protein, 566 aa, Artificial Sequence
  hemagglutinin__InfluenzaA__ABG37197
MKTIIALSYILCQVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWNGVAQDGKSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 982 - protein, 566 aa, Artificial Sequence
  hemagglutinin__InfluenzaA__ABG37208
MKTIIALSYISCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYKSESKYPALNVTMPNNGKFDKLYIWGVHHPSTDKEQTNLYVRASGRVTVSTKRSQQTVIPNIGPRPWVRGLSSRISIYWTIVKPGDILLINSTGNLIAPRGYFKIRTGKSSIMRSDAPIGTCSSGCITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDMTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 983 - protein, 566 aa, Artificial Sequence
  hemagglutinin__InfluenzaA__ABG37230
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHQSKYKYPELNVTMPNNGKFDKLYIWGVHHPSTDSDQTSLYARASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 984 - protein, 566 aa, Artificial Sequence
  hemagglutinin__InfluenzaA__ABG37241
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 985 - protein, 566 aa, Artificial Sequence
  hemagglutinin__InfluenzaA__ABG37252
MKTIIALSYILCLVFAQKLTGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 986 - protein, 566 aa, Artificial Sequence
  hemagglutinin__InfluenzaA__ABG37263
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNTCIGSIRNGTYDHDVYRDEALNNRFQIKGVELKSGYKDWILWISFAISCFLLCVVLLGFIMWACQKGNIRCNICI

SEQ ID NO: 987 - protein, 566 aa, Artificial Sequence
  hemagglutinin__InfluenzaA__ABG37274
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQISLYVRASGKVTVSTKRSQQTVIPDIGYRPWVRGLSSRISIYWTIVKPGDILLISSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 988 - protein, 566 aa, Artificial Sequence
  hemagglutinin__InfluenzaA__ABG37285
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLDYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCFVLLGFIMWACQKGNIRCNICI

SEQ ID NO: 989 - protein, 566 aa, Artificial Sequence
  hemagglutinin__InfluenzaA__ABG37296
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 990 - protein, 566 aa, Artificial Sequence; identical to SEQ ID NO: 984
  hemagglutinin__InfluenzaA__ABG37307

SEQ ID NO: 991 - protein, 566 aa, Artificial Sequence; identical to SEQ ID NO: 989
  hemagglutinin__InfluenzaA__ABG37318

SEQ ID NO: 992 - protein, 566 aa, Artificial Sequence
  hemagglutinin__InfluenzaA__ABG37329
MKTIIALSYILCLVFAQKLPENDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 993 - protein, 566 aa, Artificial Sequence
  hemagglutinin__InfluenzaA__ABG37340
MKTIIALSYILCLVFAQKLPGNDNSTATLCLGHHAVPNGTLVKTITNDQIEVTNATELVQSFPTGRICDSPHRILDGKNCTLIDALLGDPHCDGFQNKEWDLFVERSKAYSNCYPYDVPDYASLRSLVASSGTLEFTNENFNWTGVAQDGKSYSCKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 994 - protein, 566 aa, Artificial Sequence
  hemagglutinin__InfluenzaA__ABG37351
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLIDSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 995 - protein, 565 aa, Artificial Sequence
  hemagglutinin__InfluenzaA__ABG37362
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 996 - protein, 565 aa, Artificial Sequence; identical to SEQ ID NO: 800
  hemagglutinin__InfluenzaA__ABG37384

SEQ ID NO: 997 - protein, 565 aa, Artificial Sequence; identical to SEQ ID NO: 870
  hemagglutinin__InfluenzaA__ABG37395

SEQ ID NO: 998 - protein, 566 aa, Artificial Sequence; identical to SEQ ID NO: 777
  hemagglutinin__InfluenzaA__ABG37406

SEQ ID NO: 999 - protein, 566 aa, Artificial Sequence
  hemagglutinin__InfluenzaA__ABG37428
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKSHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 1000 - protein, 566 aa, Artificial Sequence; identical to SEQ ID NO: 562
  hemagglutinin__InfluenzaA__ABG37439

SEQ ID NO: 1001 - protein, 566 aa, Artificial Sequence; identical to SEQ ID NO: 640
  hemagglutinin__InfluenzaA__ABG37461

SEQ ID NO: 1002 - protein, 566 aa, Artificial Sequence
  hemagglutinin__InfluenzaA__ABG37472
MKTIIALSYILCLVFAQKLPGNDNSTATLCLGHHAVPNGTLVKTITNDQIEVTNATELVQSSSTGRICDSPHQVLDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1003 - protein, 566 aa, Artificial Sequence; identical to SEQ ID NO: 562
  hemagglutinin__InfluenzaA__ABG37483

SEQ ID NO: 1004 - protein, 566 aa, Artificial Sequence; identical to SEQ ID NO: 640
  hemagglutinin__InfluenzaA__ABG37494

SEQ ID NO: 1005 - protein, 566 aa, Artificial Sequence
  hemagglutinin__InfluenzaA__ABG37505
MKTIIALSYILCLVFAQKLPGNDNSMATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIDKCNSECITPNGSIPNDKPFQNVNRITYGLCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1006 - protein, 566 aa, Artificial Sequence; identical to SEQ ID NO: 516
  hemagglutinin__InfluenzaA__ABG37516

SEQ ID NO: 1007 - protein, 566 aa, Artificial Sequence; identical to SEQ ID NO: 516
  hemagglutinin__InfluenzaA__ABG37527

SEQ ID NO: 1008 - protein, 566 aa, Artificial Sequence; identical to SEQ ID NO: 516
  hemagglutinin__InfluenzaA__ABG37538

SEQ ID NO: 1009 - protein, 566 aa, Artificial Sequence; identical to SEQ ID NO: 516
  hemagglutinin__InfluenzaA__ABG37549

SEQ ID NO: 1010 - protein, 566 aa, Artificial Sequence; identical to SEQ ID NO: 516
  hemagglutinin__InfluenzaA__ABG37560

SEQ ID NO: 1011 - protein, 566 aa, Artificial Sequence; identical to SEQ ID NO: 516
  hemagglutinin__InfluenzaA__ABG37571

SEQ ID NO: 1012 - protein, 566 aa, Artificial Sequence
  hemagglutinin__InfluenzaA__ABG37582
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1013 - protein, 566 aa, Artificial Sequence; identical to SEQ ID NO: 516
  hemagglutinin__InfluenzaA__ABG37604

SEQ ID NO: 1014 - protein, 566 aa, Artificial Sequence; identical to SEQ ID NO: 516
  hemagglutinin__InfluenzaA__ABG37615

SEQ ID NO: 1015 - protein, 565 aa, Artificial Sequence; identical to SEQ ID NO: 742
  hemagglutinin__InfluenzaA__ABG47807

SEQ ID NO: 1016 - protein, 565 aa, Artificial Sequence; identical to SEQ ID NO: 741
  hemagglutinin__InfluenzaA__ABG47818

SEQ ID NO: 1017 - protein, 566 aa, Artificial Sequence
  hemagglutinin__InfluenzaA__ABG47829
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEITKRPKVRNQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1018 - protein, 566 aa, Artificial Sequence
  hemagglutinin__InfluenzaA__ABG47840
MKVKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMSECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1019 - protein, 566 aa, Artificial Sequence
  hemagglutinin__InfluenzaA__ABG47851
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYNHDVYRDEALNNRFQIKGVELKSGYKDWILWISFAISCFLLCVVLLGFIMWACQKGNIRCSICI

SEQ ID NO: 1020 - protein, 566 aa, Artificial Sequence
  hemagglutinin__InfluenzaA__ABG47862
MRTIIALSYILCLVFAQKLPGNDNSTATLCLGHHAVPNGTLVKTITNDQIEVTNATELVQSSSTGRICNSPHRILDGKNCTLIDALLGDPHCDGFQNKEWDLFVERSKAYSNCYPYDVPDYASLRSLIASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1021 - protein, 566 aa, Artificial Sequence; identical to SEQ ID NO: 984
  hemagglutinin__InfluenzaA__ABG47873

SEQ ID NO: 1022 - protein, 566 aa, Artificial Sequence; identical to SEQ ID NO: 989
  hemagglutinin__InfluenzaA__ABG47895

SEQ ID NO: 1023 - protein, 566 aa, Artificial Sequence; identical to SEQ ID NO: 984
  hemagglutinin__InfluenzaA__ABG47906

SEQ ID NO: 1024 - protein, 566 aa, Artificial Sequence
  hemagglutinin__InfluenzaA__ABG47917
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1025 - protein, 566 aa, Artificial Sequence; identical to SEQ ID NO: 1024
  hemagglutinin__InfluenzaA__ABG47928

SEQ ID NO: 1026 - protein, 566 aa, Artificial Sequence
  hemagglutinin__InfluenzaA__ABG47939
MKTIIALSYILCLVFAQKLPGNDNSTATLCLGHHAVPNGTLVKTITNDQIEVTNATELVQSSSTGRICDSPYRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1027 - protein, 566 aa, Artificial Sequence
  hemagglutinin__InfluenzaA__ABG47950
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASLGTLEFINEDFNWTGVAQDGKSYSCKRGSVNSFFSRLNWLHKLEYKYPALNVTMPNNGKFDKLYIWGVHHPSTDSDQTSLYARASGRVTVSTKRSQQTVIPNIGFRPWVRGLSSRISIYWTIVKPGDILLINSTGNLIAPRGYFKIRTGKSSIMRSDAPIGNCSSECITPNGNIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGFLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1028 - protein, 566 aa, Artificial Sequence
  hemagglutinin__InfluenzaA__ABG47961
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYSCKRGSVNSFFSRLNWLHKLEYKYPALNVTMPNNGKFDKLYIWGVHHPSTDSDQTSLYVRASGGVTVSTKRSQQTVIPNIGSRPWVRGLSSRISIYWTIVKPGDILLINSTGNLIAPRGYFKMRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1029 - protein, 566 aa, Artificial Sequence; identical to SEQ ID NO: 1024
  hemagglutinin__InfluenzaA__ABG47972

SEQ ID NO: 1030 - protein, 566 aa, Artificial Sequence; identical to SEQ ID NO: 1024
  hemagglutinin__InfluenzaA__ABG47983

SEQ ID NO: 1031 - protein, 566 aa, Artificial Sequence; identical to SEQ ID NO: 1024
  hemagglutinin__InfluenzaA__ABG47994

SEQ ID NO: 1032 - protein, 566 aa, Artificial Sequence
  hemagglutinin__InfluenzaA__ABG48005
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1033 - protein, 566 aa, Artificial Sequence; identical to SEQ ID NO: 1024
  hemagglutinin__InfluenzaA__ABG48016

SEQ ID NO: 1034 - protein, 566 aa, Artificial Sequence; identical to SEQ ID NO: 1024
  hemagglutinin__InfluenzaA__ABG48027

SEQ ID NO: 1035 - protein, 565 aa, Artificial Sequence
  hemagglutinin__InfluenzaA__ABG48049
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSTHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1036 - protein, 566 aa, Artificial Sequence; identical to SEQ ID NO: 650
  hemagglutinin__InfluenzaA__ABG48060

SEQ ID NO: 1037 - protein, 566 aa, Artificial Sequence; identical to SEQ ID NO: 650
  hemagglutinin__InfluenzaA__ABG48071

SEQ ID NO: 1038 - protein, 566 aa, Artificial Sequence
  hemagglutinin__InfluenzaA__ABG48082
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVLHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1039 - protein, 566 aa, Artificial Sequence
  hemagglutinin__InfluenzaA__ABG48104
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSRAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1040 - protein, 566 aa, Artificial Sequence; identical to SEQ ID NO: 640
  hemagglutinin__InfluenzaA__ABG48115

SEQ ID NO: 1041 - protein, 566 aa, Artificial Sequence; identical to SEQ ID NO: 647
  hemagglutinin__InfluenzaA__ABG48126

SEQ ID NO: 1042 - protein, 566 aa, Artificial Sequence; identical to SEQ ID NO: 562
  hemagglutinin__InfluenzaA__ABG48148

SEQ ID NO: 1043 - protein, 566 aa, Artificial Sequence; identical to SEQ ID NO: 562
  hemagglutinin__InfluenzaA__ABG48159

SEQ ID NO: 1044 - protein, 566 aa, Artificial Sequence
  hemagglutinin__InfluenzaA__ABG48170
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMKSDAPIGKCNFECITPNGSIPNGKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1045 - protein, 566 aa, Artificial Sequence
  hemagglutinin__InfluenzaA__ABG48181
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSYACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 1046 - protein, 566 aa, Artificial Sequence; identical to SEQ ID NO: 562
  hemagglutinin__InfluenzaA__ABG48192

SEQ ID NO: 1047 - protein, 566 aa, Artificial Sequence
  hemagglutinin__InfluenzaA__ABG48203
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNVCI

SEQ ID NO: 1048 - protein, 566 aa, Artificial Sequence; identical to SEQ ID NO: 516
  hemagglutinin__InfluenzaA__ABG48214

SEQ ID NO: 1049 - protein, 566 aa, Artificial Sequence; identical to SEQ ID NO: 516
  hemagglutinin__InfluenzaA__ABG48236

SEQ ID NO: 1050 - protein, 566 aa, Artificial Sequence
  hemagglutinin__InfluenzaA__ABG48247
MKTIIALSYILCLVFAQKLPGNDNNTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1051 - protein, 566 aa, Artificial Sequence
  hemagglutinin__InfluenzaA__ABG48269
MKTIIALSYILCLVFAQKLPGNDNSTATLCLGHHAVPNGTIVKTITNDQIEVTNATELVQSSPTGGICDSPHQILDGENCTLIDALLGDPQCDGFQNKKWDLFVERSKAHSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1052 - protein, 566 aa, Artificial Sequence
  hemagglutinin__InfluenzaA__ABG48291
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKSEYKYPALNVSMPNNGKFNKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGTCSFECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1053 - protein, 566 aa, Artificial Sequence
  hemagglutinin__InfluenzaA__ABG48335
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1054 - protein, 566 aa, Artificial Sequence
  hemagglutinin__InfluenzaA__ABG48346
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERNKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDRPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1055 - protein, 566 aa, Artificial Sequence; identical to SEQ ID NO: 1053
  hemagglutinin__InfluenzaA__ABG48357

SEQ ID NO: 1056 - protein, 566 aa, Artificial Sequence
  hemagglutinin__InfluenzaA__ABG48368
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKVYHKCDNACIESIRNGTYDHDVYRDEALNNRFQIKGVELKSGYKDWILWISFAISCFLLCVVLLGFIMWACQKGNIRCNICI

SEQ ID NO: 1057 - protein, 566 aa, Artificial Sequence; identical to SEQ ID NO: 907
  hemagglutinin__InfluenzaA__ABG67135

SEQ ID NO: 1058 - protein, 566 aa, Artificial Sequence; identical to SEQ ID NO: 783
  hemagglutinin__InfluenzaA__ABG67146

SEQ ID NO: 1059 - protein, 566 aa, Artificial Sequence
  hemagglutinin__InfluenzaA__ABG67157
MKTIIALSYILCLVFAQKLPGNDNSTATLCLGHHAVPNGTLVKTITNDQIEVTNATELVQSSPTGRICNSPHRIIDGKNCTLIDALLGDPHCDGFQNKEWDLFVERSKAYSNCYPYDVPDYASLRSLVASSGTLEFINENFNWTGVAQDGKSYACKRGSVNSFFSRLNWLHKLEYKYPALNVTMPNNGKFDKLYIWGVHHPSTDSDQTSLYVRASGRVTVSTKRSQQTVIPDIGYRPWVRGLSSRISIYWTIVKPGDILLINSTGNLIAPRGYFKLRNGKSSIMRSDAPIGNCSSECITPNGSIPNDKPFQNVNRITYGACPRYIKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1060 - protein, 566 aa, Artificial Sequence; identical to SEQ ID NO: 984
  hemagglutinin__InfluenzaA__ABG67168

SEQ ID NO: 1061 - protein, 566 aa, Artificial Sequence; identical to SEQ ID NO: 984
  hemagglutinin__InfluenzaA__ABG67179

SEQ ID NO: 1062 - protein, 566 aa, Artificial Sequence
  hemagglutinin__InfluenzaA__ABG67190
MKTIIALSYILCLVFAQKLPGNDNSTATLCLGHHAVPNGTLVKTITNDQIEVTNATELVQSFPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1063 - protein, 566 aa, Artificial Sequence
  hemagglutinin__InfluenzaA__ABG67212
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYRYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1064 - protein, 566 aa, Artificial Sequence; identical to SEQ ID NO: 1024
  hemagglutinin__InfluenzaA__ABG67223

SEQ ID NO: 1065 - protein, 566 aa, Artificial Sequence
  hemagglutinin__InfluenzaA__ABG67234
MKTIIALSYILCLVFAQKLPGDDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVEPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1066 - protein, 566 aa, Artificial Sequence
  hemagglutinin__InfluenzaA__ABG67245
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQIDGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1067 - protein, 565 aa, Artificial Sequence; identical to SEQ ID NO: 742
  hemagglutinin__InfluenzaA__ABG67477

SEQ ID NO: 1068 - protein, 565 aa, Artificial Sequence; identical to SEQ ID NO: 800
  hemagglutinin__InfluenzaA__ABG67491

SEQ ID NO: 1069 - protein, 566 aa, Artificial Sequence
  hemagglutinin__InfluenzaA__ABG67502
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVSDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1070 - protein, 566 aa, Artificial Sequence
  hemagglutinin__InfluenzaA__ABG67524
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSRAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAVNQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1071 - protein, 566 aa, Artificial Sequence; identical to SEQ ID NO: 562
  hemagglutinin__InfluenzaA__ABG67535

SEQ ID NO: 1072 - protein, 566 aa, Artificial Sequence; identical to SEQ ID NO: 516
  hemagglutinin__InfluenzaA__ABG67546

SEQ ID NO: 1073 - protein, 566 aa, Artificial Sequence
  hemagglutinin__InfluenzaA__ABG67557
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQATINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1074 - protein, 566 aa, Artificial Sequence; identical to SEQ ID NO: 516
  hemagglutinin__InfluenzaA__ABG67568

SEQ ID NO: 1075 - protein, 566 aa, Artificial Sequence; identical to SEQ ID NO: 516
  hemagglutinin__InfluenzaA__ABG67579

SEQ ID NO: 1076 - protein, 566 aa, Artificial Sequence; identical to SEQ ID NO: 516
  hemagglutinin__InfluenzaA__ABG67590

SEQ ID NO: 1077 - protein, 566 aa, Artificial Sequence; identical to SEQ ID NO: 516
  hemagglutinin__InfluenzaA__ABG67601

SEQ ID NO: 1078 - protein, 566 aa, Artificial Sequence; identical to SEQ ID NO: 516
  hemagglutinin__InfluenzaA__ABG67612

SEQ ID NO: 1079 - protein, 566 aa, Artificial Sequence; identical to SEQ ID NO: 516
  hemagglutinin__InfluenzaA__ABG67623

SEQ ID NO: 1080 - protein, 566 aa, Artificial Sequence
  hemagglutinin__InfluenzaA__ABG67634
MKTIIALSYILCLVFAQKLPGNDNNTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSKMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1081 - protein, 566 aa, Artificial Sequence; identical to SEQ ID NO: 516
  hemagglutinin__InfluenzaA__ABG67645

SEQ ID NO: 1082 - protein, 566 aa, Artificial Sequence
  hemagglutinin__InfluenzaA__ABG67656
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWAGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEIEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1083 - protein, 566 aa, Artificial Sequence
  hemagglutinin__InfluenzaA__ABG67667
MKTIIALSYILCQVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWIGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMIDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1084 - protein, 566 aa, Artificial Sequence
  hemagglutinin__InfluenzaA__ABG79941
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCSICI

SEQ ID NO: 1085 - protein, 566 aa, Artificial Sequence; identical to SEQ ID NO: 921
  hemagglutinin__InfluenzaA__ABG79952

SEQ ID NO: 1086 - protein, 566 aa, Artificial Sequence; identical to SEQ ID NO: 984
  hemagglutinin__InfluenzaA__ABG79974

SEQ ID NO: 1087 - protein, 566 aa, Artificial Sequence; identical to SEQ ID NO: 984
  hemagglutinin__InfluenzaA__ABG79985

SEQ ID NO: 1088 - protein, 566 aa, Artificial Sequence
  hemagglutinin__InfluenzaA__ABG79996
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFTNENFNWTGVAQDGKSYSCKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1089 - protein, 566 aa, Artificial Sequence; identical to SEQ ID NO: 984
  hemagglutinin__InfluenzaA__ABG80007

SEQ ID NO: 1090 - protein, 566 aa, Artificial Sequence; identical to SEQ ID NO: 984
  hemagglutinin__InfluenzaA__ABG80018

SEQ ID NO: 1091 - protein, 566 aa, Artificial Sequence; identical to SEQ ID NO: 989
  hemagglutinin__InfluenzaA__ABG80029

SEQ ID NO: 1092 - protein, 566 aa, Artificial Sequence; identical to SEQ ID NO: 989
  hemagglutinin__InfluenzaA__ABG80040

SEQ ID NO: 1093 - protein, 566 aa, Artificial Sequence; identical to SEQ ID NO: 984
  hemagglutinin__InfluenzaA__ABG80051

SEQ ID NO: 1094 - protein, 566 aa, Artificial Sequence
  hemagglutinin__InfluenzaA__ABG80062
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKTGYKDWILWISFAISCFLLCVVLLGFIMWACQKGNIRCNICI

SEQ ID NO: 1095 - protein, 566 aa, Artificial Sequence
  hemagglutinin__InfluenzaA__ABG80073
MKTIIALSYILCLVFAQKLPGNDNSTATLCLGHHAVPNGTLVKTITNDQIEVTNATELVQSSSTGRICDSPHRILDGKNCTLIDALLGDPNCDGFQNKEWDLFVERSKAYSNCYPYDVPDYASLRSLVASSGTLEFTNEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1096 - protein, 566 aa, Artificial Sequence
  hemagglutinin__InfluenzaA__ABG80084
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSGISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDIYRDEALNNRFQIKGVELKSGYKDWILWISFAISCFLLCVVLLGFIMWACQKGNIRCNICI

SEQ ID NO: 1097 - protein, 566 aa, Artificial Sequence
  hemagglutinin__InfluenzaA__ABG80095
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKVDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1098 - protein, 566 aa, Artificial Sequence; identical to SEQ ID NO: 1024
  hemagglutinin__InfluenzaA__ABG80106

SEQ ID NO: 1099 - protein, 566 aa, Artificial Sequence
  hemagglutinin__InfluenzaA__ABG80117
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPVKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1100 - protein, 566 aa, Artificial Sequence
  hemagglutinin__InfluenzaA__ABG80128
MKTIIALSYILCLVFAQKLPGNDNSTATLCLGHHAVPNGTLVKTITNDRIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1101 - protein, 566 aa, Artificial Sequence
  hemagglutinin__InfluenzaA__ABG80139
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSYECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNTCIGSIRNGTYDHDVYRDEALNNRFQIKGVELKSGYKDWILWISFAISCFLLCVVLLGFIMWACQKGNIRCNICI

SEQ ID NO: 1102 - protein, 566 aa, Artificial Sequence
  hemagglutinin__InfluenzaA__ABG80150
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINENFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSGISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1103 - protein, 566 aa, Artificial Sequence
  hemagglutinin__InfluenzaA__ABG80161
MKTIIALSYISCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVQASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1104 - protein, 565 aa, Artificial Sequence
  hemagglutinin__InfluenzaA__ABG80172
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHNSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1105 - protein, 565 aa, Artificial Sequence
  hemagglutinin__InfluenzaA__ABG80183
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGGQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1106 - protein, 566 aa, Artificial Sequence
  hemagglutinin__InfluenzaA__ABG80194
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWNLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSIISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1107 - protein, 566 aa, Artificial Sequence
  hemagglutinin__InfluenzaA__ABG80205
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVAMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKINLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1108 - protein, 566 aa, Artificial Sequence
  hemagglutinin__InfluenzaA__ABG80216
MKTIIALSYILCLVFAQKLPVNDNSTATLCLGHHAVPNGTLVKTITNDHIEVTNATELVQSSPTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINSTGNLIAPRGYFKIRSGKSSIMRSNTPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1109 - protein, 566 aa, Artificial Sequence; identical to SEQ ID NO: 640
  hemagglutinin__InfluenzaA__ABG80227

SEQ ID NO: 1110 - protein, 566 aa, Artificial Sequence; identical to SEQ ID NO: 516
  hemagglutinin__InfluenzaA__ABG80238

SEQ ID NO: 1111 - protein, 566 aa, Artificial Sequence; identical to SEQ ID NO: 516
  hemagglutinin__InfluenzaA__ABG80249

SEQ ID NO: 1112 - protein, 566 aa, Artificial Sequence; identical to SEQ ID NO: 516
  hemagglutinin__InfluenzaA__ABG80260

SEQ ID NO: 1113 - protein, 566 aa, Artificial Sequence
  hemagglutinin__InfluenzaA__ABG80271
MKTIIALSYILCLVFAQKLPGNDNSTATLCLGHHAVPNGTVVKTITNDQIEVTNATELVQSSSTGGICDSPHQILDGENCTLMDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1114 - protein, 566 aa, Artificial Sequence; identical to SEQ ID NO: 591
  hemagglutinin__InfluenzaA__ABG80282

SEQ ID NO: 1115 - protein, 566 aa, Artificial Sequence; identical to SEQ ID NO: 243
  hemagglutinin__InfluenzaA__ABG80293

SEQ ID NO: 1116 - protein, 566 aa, Artificial Sequence
  hemagglutinin__InfluenzaA__ABG80304
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQINLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1117 - protein, 566 aa, Artificial Sequence
  hemagglutinin__InfluenzaA__ABG80315
MKTIIALSYILCLVFAQKLPGNDNSTATLCLGHHAVPNGTIVKTITNDQIEVTNATELIQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDMLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1118 - protein, 566 aa, Artificial Sequence; identical to SEQ ID NO: 282
  hemagglutinin__InfluenzaA__ABG80326

SEQ ID NO: 1119 - protein, 566 aa, Artificial Sequence; identical to SEQ ID NO: 282
  hemagglutinin__InfluenzaA__ABG80337

SEQ ID NO: 1120 - protein, 566 aa, Artificial Sequence
  hemagglutinin__InfluenzaA__ABG80359
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGNCSSECITPNGSIPSDKPFQNVNRITYGACPRYVKQNTLKLATGMRNVPEKQTRGIFGAIAGFIENGWEGMVDGWYGFRHQNSEGTGQAADLKSTQAAVDQINGKLNRLIERTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1121 - protein, 566 aa, Artificial Sequence
  hemagglutinin__InfluenzaA__ABG80370
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVKSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1122 - protein, 566 aa, Artificial Sequence; identical to SEQ ID NO: 1053
  hemagglutinin__InfluenzaA__ABG80392

SEQ ID NO: 1123 - protein, 566 aa, Artificial Sequence; identical to SEQ ID NO: 1053
  hemagglutinin__InfluenzaA__ABG80403

SEQ ID NO: 1124 - protein, 566 aa, Artificial Sequence; identical to SEQ ID NO: 1053
  hemagglutinin__InfluenzaA__ABG80414

SEQ ID NO: 1125 - protein, 566 aa, Artificial Sequence; identical to SEQ ID NO: 1053
  hemagglutinin__InfluenzaA__ABG80425

SEQ ID NO: 1126 - protein, 566 aa, Artificial Sequence; identical to SEQ ID NO: 783
  hemagglutinin__InfluenzaA__ABG88289

SEQ ID NO: 1127 - protein, 566 aa, Artificial Sequence
  hemagglutinin__InfluenzaA__ABG88300
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPDLSKSYVNNKEKEVLVLWGVHHPSNIGDQRAIYHTENAYVSVVSSHYSRRFTPEITKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1128 - protein, 566 aa, Artificial Sequence; identical to SEQ ID NO: 911
  hemagglutinin__InfluenzaA__ABG88311

SEQ ID NO: 1129 - protein, 566 aa, Artificial Sequence
  hemagglutinin__InfluenzaA__ABG88322
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPILSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1130 - protein, 566 aa, Artificial Sequence
  hemagglutinin__InfluenzaA__ABG88333
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHNVTRGVTASCSHKGKSSFYRNLLWLTEKNGSYPNLSKSYVNNKEKEVLVLWGVHHPSNIEDQKTIYRKENAYVSVVSSHYNRRFTPEISKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1131 - protein, 566 aa, Artificial Sequence
  hemagglutinin__InfluenzaA__ABG88344
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHNVTRGVTASCSHKGKSSFYRNLLWLTEKNGSYPNLSKSYVNNKEKEVLVLWGVHHPSNIEDQKTIYRKENAYVSVVSSHYNRRFTPEISKRPKVRNQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1132 - protein, 566 aa, Artificial Sequence
  hemagglutinin__InfluenzaA__ABG88355
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGESSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1133 - protein, 566 aa, Artificial Sequence
  hemagglutinin__InfluenzaA__ABG88366
MKTIIALSYFLCLVFAQKLPGNDNSTATLCLGHHAVPNGTLVKTITNDQIEVTNATELVQNSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1134 - protein, 566 aa, Artificial Sequence; identical to SEQ ID NO: 984
  hemagglutinin__InfluenzaA__ABG88377

SEQ ID NO: 1135 - protein, 566 aa, Artificial Sequence; identical to SEQ ID NO: 984
  hemagglutinin__InfluenzaA__ABG88388

SEQ ID NO: 1136 - protein, 566 aa, Artificial Sequence
  hemagglutinin__InfluenzaA__ABG88399
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKESFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1137 - protein, 566 aa, Artificial Sequence; identical to SEQ ID NO: 1024
  hemagglutinin__InfluenzaA__ABG88410

SEQ ID NO: 1138 - protein, 566 aa, Artificial Sequence; identical to SEQ ID NO: 1024
  hemagglutinin__InfluenzaA__ABG88421

SEQ ID NO: 1139 - protein, 566 aa, Artificial Sequence
  hemagglutinin__InfluenzaA__ABG88432
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKMRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1140 - protein, 566 aa, Artificial Sequence; identical to SEQ ID NO: 1024
  hemagglutinin__InfluenzaA__ABG88443

SEQ ID NO: 1141 - protein, 566 aa, Artificial Sequence
  hemagglutinin__InfluenzaA__ABG88454
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSANSFFSRLNWLHKLEYKYPALNVTMPNNGKFDKLYIWGVHHPSTDSDQTSLYVRASGGVTVSTKRSQQTVIPNIGSRPWVRGLSSRISIYWTIVKPGDILLINSTGNLIAPRGYFKIRSGKSSIMRSDASIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNDKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1142 - protein, 566 aa, Artificial Sequence
  hemagglutinin__InfluenzaA__ABG88465
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNIPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1143 - protein, 566 aa, Artificial Sequence; identical to SEQ ID NO: 1024
  hemagglutinin__InfluenzaA__ABG88476

SEQ ID NO: 1144 - protein, 566 aa, Artificial Sequence; identical to SEQ ID NO: 1024
  hemagglutinin__InfluenzaA__ABG88487

SEQ ID NO: 1145 - protein, 566 aa, Artificial Sequence; identical to SEQ ID NO: 1024
  hemagglutinin__InfluenzaA__ABG88498

SEQ ID NO: 1146 - protein, 566 aa, Artificial Sequence; identical to SEQ ID NO: 1024
  hemagglutinin__InfluenzaA__ABG88509

SEQ ID NO: 1147 - protein, 566 aa, Artificial Sequence
  hemagglutinin__InfluenzaA__ABG88520
MKTIIALSYISCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFTMWACQKGNIRCNICI

SEQ ID NO: 1148 - protein, 566 aa, Artificial Sequence
  hemagglutinin__InfluenzaA__ABG88531
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSVQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1149 - protein, 565 aa, Artificial Sequence; identical to SEQ ID NO: 1035
  hemagglutinin__InfluenzaA__ABG88553

SEQ ID NO: 1150 - protein, 566 aa, Artificial Sequence; identical to SEQ ID NO: 710
  hemagglutinin__InfluenzaA__ABG88564

SEQ ID NO: 1151 - protein, 566 aa, Artificial Sequence; identical to SEQ ID NO: 740
  hemagglutinin__InfluenzaA__ABG88575

SEQ ID NO: 1152 - protein, 566 aa, Artificial Sequence; identical to SEQ ID NO: 650
  hemagglutinin__InfluenzaA__ABG88586

SEQ ID NO: 1153 - protein, 566 aa, Artificial Sequence
  hemagglutinin__InfluenzaA__ABG88597
MKTIIALSYILCLVFAQKLPANDNSTATLCLGHHAVPNGTLVKTITNDNIEVTNATELVQSSSTGRICDSPHQILDGENCTLIDALLGDPHCDGFQNKEWDLFVERSTAYSNCYPYDVPDYASLRSLVASSGTLEFNNESFNWTGVDQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1154 - protein, 566 aa, Artificial Sequence
  hemagglutinin__InfluenzaA__ABG88608
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSRAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNTRFQIKGVELKSGYKDWILWISFAISCFLLCIVLLGFIMWACQKGNIRCNICI

SEQ ID NO: 1155 - protein, 566 aa, Artificial Sequence; identical to SEQ ID NO: 562
  hemagglutinin__InfluenzaA__ABG88619

SEQ ID NO: 1156 - protein, 566 aa, Artificial Sequence
  hemagglutinin__InfluenzaA__ABG88630
MKTIIALSYILCLVFAQKLPGNDNSTATLCLGHHAVPNGTLVKTITNDQIEVTNATELVQSSSTGRICDSPHQVLDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQKTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1157 - protein, 566 aa, Artificial Sequence
  hemagglutinin__InfluenzaA__ABG88641
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFATSCFLLCIVLLGFIMWACQKGNIRCNICI

SEQ ID NO: 1158 - protein, 566 aa, Artificial Sequence; identical to SEQ ID NO: 516
  hemagglutinin__InfluenzaA__ABG88652

SEQ ID NO: 1159 - protein, 566 aa, Artificial Sequence; identical to SEQ ID NO: 516
  hemagglutinin__InfluenzaA__ABG88663

SEQ ID NO: 1160 - protein, 566 aa, Artificial Sequence; identical to SEQ ID NO: 516
  hemagglutinin__InfluenzaA__ABG88674

SEQ ID NO: 1161 - protein, 566 aa, Artificial Sequence; identical to SEQ ID NO: 516
  hemagglutinin__InfluenzaA__ABG88685

SEQ ID NO: 1162 - protein, 566 aa, Artificial Sequence; identical to SEQ ID NO: 516
  hemagglutinin__InfluenzaA__ABG88696

SEQ ID NO: 1163 - protein, 566 aa, Artificial Sequence; identical to SEQ ID NO: 282
  hemagglutinin__InfluenzaA__ABG88707

SEQ ID NO: 1164 - protein, 566 aa, Artificial Sequence; identical to SEQ ID NO: 282
  hemagglutinin__InfluenzaA__ABG88718

SEQ ID NO: 1165 - protein, 566 aa, Artificial Sequence
  hemagglutinin__InfluenzaA__ABG88729
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNSGKFDKLYIWGVHHPSTDSDQTSLYVRASGRVTVSTKRSQQTVTPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1166 - protein, 566 aa, Artificial Sequence
  hemagglutinin__InfluenzaA__ABG88740
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYIKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1167 - protein, 566 aa, Artificial Sequence; identical to SEQ ID NO: 1053
  hemagglutinin__InfluenzaA__ABG88751

SEQ ID NO: 1168 - protein, 566 aa, Artificial Sequence
  hemagglutinin__InfluenzaA__ABG88762
MKTIIALSYILCLVFTQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDASIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEVSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKSVELKSGYKDWILWISFAISCFLLCVVLLGFIMWACQKGNIRCNICI

SEQ ID NO: 1169 - protein, 566 aa, Artificial Sequence
  hemagglutinin__InfluenzaA__ABG88773
MKTIIALSYILCLVFAQKLPGNDNSTATLCLGHHAVPNGTLVKTITNDQIEVTNATELVQSSSAGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAATDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1170 - protein, 566 aa, Artificial Sequence
  hemagglutinin__InfluenzaA__ABG88784
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIKKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1171 - protein, 566 aa, Artificial Sequence
  hemagglutinin__InfluenzaA__ABG88806
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTVPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1172 - protein, 567 aa, Artificial Sequence
  hemagglutinin__InfluenzaA__ABI16504
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIISKSSWSDHEASSGVSSACPYQGTPSFFRNVVWLIKKNNTYPTIKRSYNNTNQEDLLILWGIHHSNNAAEQTKLYQNPTTYISVGTSTLNLRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 1173 - protein, 566 aa, Artificial Sequence; identical to SEQ ID NO: 633
  hemagglutinin__InfluenzaA__ABI20793

SEQ ID NO: 1174 - protein, 566 aa, Artificial Sequence
  hemagglutinin__InfluenzaA__ABI20837
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1175 - protein, 566 aa, Artificial Sequence
  hemagglutinin__InfluenzaA__ABI20848
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELKEQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAHVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 1176 - protein, 566 aa, Artificial Sequence; identical to SEQ ID NO: 921
  hemagglutinin__InfluenzaA__ABI20859

SEQ ID NO: 1177 - protein, 566 aa, Artificial Sequence
  hemagglutinin__InfluenzaA__ABI20870
MKAKLLVLLCAFTATYADTICIGYHANNSTDTVDTVLEKNVTVTHSVNLLEDSHNGKLCRLKGIAPLQLGNCSVAGWILGNPECESLFSKESWSYIAETPNPENGTCYPGNFADYEELREQLSSVSSFERFEIFPKESSWPNHTVTKGVTVSCSHNGKSSFYRNLLWLTEKNGLYPNLSKSYVNNKEKEVLVLWGVHHPSNMRDQRAIYHTENAYVSVVSSHYSRRFTPEIAKRPKVRDQEGRINYYWTLLEPGDTIIFEANGNLIAPRYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1178 - protein, 566 aa, Artificial Sequence; identical to SEQ ID NO: 989
  hemagglutinin__InfluenzaA__ABI20881

SEQ ID NO: 1179 - protein, 566 aa, Artificial Sequence
  hemagglutinin__InfluenzaA__ABI20892
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIHWTIVKPGDILLITSTGNLIAPRGYFKIRNGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1180 - protein, 566 aa, Artificial Sequence
  hemagglutinin__InfluenzaA__ABI20903
MKTIIALSYILCLVFAQKLPGNDNSTATLCLGHHAVPNGTLVKTITNDQIEVTNATELVQNSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLIHSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1181 - protein, 566 aa, Artificial Sequence
  hemagglutinin__InfluenzaA__ABI20914
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVSLGFIMWACQKGNIRCNICI

SEQ ID NO: 1182 - protein, 566 aa, Artificial Sequence; identical to SEQ ID NO: 1066
  hemagglutinin__InfluenzaA__ABI20925

SEQ ID NO: 1183 - protein, 566 aa, Artificial Sequence; identical to SEQ ID NO: 1066
  hemagglutinin__InfluenzaA__ABI20936

SEQ ID NO: 1184 - protein, 566 aa, Artificial Sequence
  hemagglutinin__InfluenzaA__ABI20947
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEQEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1185 - protein, 566 aa, Artificial Sequence
  hemagglutinin__InfluenzaA__ABI20958
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLYKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1186 - protein, 566 aa, Artificial Sequence
  hemagglutinin__InfluenzaA__ABI20969
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWNLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1187 - protein, 566 aa, Artificial Sequence
  hemagglutinin__InfluenzaA__ABI20980
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVDQNGTSSACKRRSTKSFFSRLNWLHQLKYKYPALNVTMPNNEKFDKLYIWGVHHPSTDSDQISLYAQASGRVTVSTKRSQQTVTPNIGSRPWVRGVSSRISIYWTIVKPGDILLINSTGNLIAPRGYFKIRSGKSSIMRSNALIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAEILVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1188 - protein, 566 aa, Artificial Sequence
  hemagglutinin__InfluenzaA__ABI20991
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEINKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1189 - protein, 566 aa, Artificial Sequence; identical to SEQ ID NO: 710
  hemagglutinin__InfluenzaA__ABI21002

SEQ ID NO: 1190 - protein, 566 aa, Artificial Sequence; identical to SEQ ID NO: 1154
  hemagglutinin__InfluenzaA__ABI21013

SEQ ID NO: 1191 - protein, 566 aa, Artificial Sequence; identical to SEQ ID NO: 640
  hemagglutinin__InfluenzaA__ABI21024

SEQ ID NO: 1192 - protein, 566 aa, Artificial Sequence; identical to SEQ ID NO: 516
  hemagglutinin__InfluenzaA__ABI21035

SEQ ID NO: 1193 - protein, 566 aa, Artificial Sequence
  hemagglutinin__InfluenzaA__ABI21046
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1194 - protein, 566 aa, Artificial Sequence
  hemagglutinin__InfluenzaA__ABI21057
MKTIIALSYILCLVFAQKLPGNDNSTATLCLGHHAVPNGTIVKTITNDQIEVTNATELVQNSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1195 - protein, 566 aa, Artificial Sequence; identical to SEQ ID NO: 243
  hemagglutinin__InfluenzaA__ABI21068

SEQ ID NO: 1196 - protein, 566 aa, Artificial Sequence; identical to SEQ ID NO: 282
  hemagglutinin__InfluenzaA__ABI21079

SEQ ID NO: 1197 - protein, 566 aa, Artificial Sequence; identical to SEQ ID NO: 1113
  hemagglutinin__InfluenzaA__ABI21090

SEQ ID NO: 1198 - protein, 566 aa, Artificial Sequence; identical to SEQ ID NO: 1113
  hemagglutinin__InfluenzaA__ABI21101

SEQ ID NO: 1199 - protein, 566 aa, Artificial Sequence
  hemagglutinin__InfluenzaA__ABI21123
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKHVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1200 - protein, 566 aa, Artificial Sequence
  hemagglutinin__InfluenzaA__ABI21134
MKTIIALSYILCLVFAQKLPGNDNSTATLCLGHHAVPNGTVVKTITNDQIEVTNATELVQSSSTGGICDSPHQILDGENCTLMDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRSRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1201 - protein, 566 aa, Artificial Sequence; identical to SEQ ID NO: 282
  hemagglutinin__InfluenzaA__ABI21156

SEQ ID NO: 1202 - protein, 566 aa, Artificial Sequence
  hemagglutinin__InfluenzaA__ABI21167
MKTIIALGYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHEVYRDEALNNRFQIKGVELKSGYKDWILWISFAISCFLLCVALLGFIMWACQKGNIRCNICI

SEQ ID NO: 1203 - protein, 566 aa, Artificial Sequence
  hemagglutinin__InfluenzaA__ABI21178
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSSCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1204 - protein, 565 aa, Artificial Sequence
  hemagglutinin__InfluenzaA__ABI21200
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNRERIDGVKLESMGVYQILAIYSTVASSLVLLVSLGAISFWMCSNGSLQCRICI

SEQ ID NO: 1205 - protein, 565 aa, Artificial Sequence; identical to SEQ ID NO: 1204
  hemagglutinin__InfluenzaA__ABI21211

SEQ ID NO: 1206 - protein, 565 aa, Artificial Sequence
  hemagglutinin__InfluenzaA__ABI21233
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLNSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNRERIDGVKLESMGVYQILAIYSTVASSLVLLVSLGAISFWMCSNGSLQCRICI

SEQ ID NO: 1207 - protein, 566 aa, Artificial Sequence
  hemagglutinin__InfluenzaA__ABI21244
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLKFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRSGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1208 - protein, 566 aa, Artificial Sequence; identical to SEQ ID NO: 1053
  hemagglutinin__InfluenzaA__ABI21255

SEQ ID NO: 1209 - protein, 566 aa, Artificial Sequence; identical to SEQ ID NO: 1053
  hemagglutinin__InfluenzaA__ABI21266

SEQ ID NO: 1210 - protein, 566 aa, Artificial Sequence; identical to SEQ ID NO: 1053
  hemagglutinin__InfluenzaA__ABI21277

SEQ ID NO: 1211 - protein, 566 aa, Artificial Sequence
  hemagglutinin__InfluenzaA__ABI21299
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNDKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1212 - protein, 566 aa, Artificial Sequence; identical to SEQ ID NO: 1053
  hemagglutinin__InfluenzaA__ABI21310

SEQ ID NO: 1213 - protein, 566 aa, Artificial Sequence
  hemagglutinin__InfluenzaA__ABI21321
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1214 - protein, 566 aa, Artificial Sequence
  hemagglutinin__InfluenzaA__ABI21332
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVQASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1215 - protein, 566 aa, Artificial Sequence; identical to SEQ ID NO: 1053
  hemagglutinin__InfluenzaA__ABI21343

SEQ ID NO: 1216 - protein, 566 aa, Artificial Sequence
  hemagglutinin__InfluenzaA__ABI21354
MKTIIALSYISCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1217 - protein, 566 aa, Artificial Sequence
  hemagglutinin__InfluenzaA__ABI21365
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMDKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1218 - protein, 566 aa, Artificial Sequence
  hemagglutinin__InfluenzaA__ABI21376
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYSCKRGSVNSFFSRLNWLHKLEYKYPALNVTMPNNDKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1219 - protein, 566 aa, Artificial Sequence; identical to SEQ ID NO: 1053
  hemagglutinin__InfluenzaA__ABI21387

SEQ ID NO: 1220 - protein, 566 aa, Artificial Sequence
  hemagglutinin__InfluenzaA__ABI21398
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFVNEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1221 - protein, 566 aa, Artificial Sequence; identical to SEQ ID NO: 1053
  hemagglutinin__InfluenzaA__ABI21409

SEQ ID NO: 1222 - protein, 566 aa, Artificial Sequence
  hemagglutinin__InfluenzaA__ABI21420
MKTIIALSYILCLVFTQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYSCKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKSVELKSGYKDWILWISFAISCFLLCVVLLGFIMWACQKGNIRCNICI

SEQ ID NO: 1223 - protein, 566 aa, Artificial Sequence; identical to SEQ ID NO: 1053
  hemagglutinin__InfluenzaA__ABI21431

SEQ ID NO: 1224 - protein, 566 aa, Artificial Sequence; identical to SEQ ID NO: 1053
  hemagglutinin__InfluenzaA__ABI21442

SEQ ID NO: 1225 - protein, 566 aa, Artificial Sequence; identical to SEQ ID NO: 1053
  hemagglutinin__InfluenzaA__ABI21453

SEQ ID NO: 1226 - protein, 566 aa, Artificial Sequence; identical to SEQ ID NO: 1053
  hemagglutinin__InfluenzaA__ABI21464

SEQ ID NO: 1227 - protein, 566 aa, Artificial Sequence; identical to SEQ ID NO: 1053
  hemagglutinin__InfluenzaA__ABI21475

SEQ ID NO: 1228 - protein, 566 aa, Artificial Sequence
  hemagglutinin__InfluenzaA__ABI21486
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGSRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQEAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1229 - protein, 566 aa, Artificial Sequence; identical to SEQ ID NO: 1053
  hemagglutinin__InfluenzaA__ABI21497

SEQ ID NO: 1230 - protein, 565 aa, Artificial Sequence
  hemagglutinin__InfluenzaA__ABI21530
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIGVQRAIYRTENAYVSVVSSHYSRRFTPEIAKRPKVRDQEGRINYYWTLLEPGDTIIFEANGNLIAPWYAFALSRGFESGIITSNAPMNECDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1231 - protein, 565 aa, Artificial Sequence
  hemagglutinin__InfluenzaA__ABI21552
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIGVQRAIYHTENAYVSVVSSHYSRRFTPEIAKRPKVRDQEGRINYYWTLLEPGDTIIFEANGNLIAPWYAFALSRGFESGIITSNAPMDECDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1232 - protein, 565 aa, Artificial Sequence
  hemagglutinin__InfluenzaA__ABI21563
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIGVQRAIYHTENAYVSVVSSHYSRRFTPEIAKRPKVRGQEGRINYYWTLLEPGDTIIFEANGNLIAPWYAFALSRGFESGIITSNAPMNECDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1233 - protein, 565 aa, Artificial Sequence; identical to SEQ ID NO: 1232
  hemagglutinin__InfluenzaA__ABI21574

SEQ ID NO: 1234 - protein, 566 aa, Artificial Sequence
  hemagglutinin__InfluenzaA__ABI21736
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDVGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1235 - protein, 566 aa, Artificial Sequence
  hemagglutinin__InfluenzaA__ABI22159
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSNAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1236 - protein, 568 aa, Artificial Sequence
  hemagglutinin__InfluenzaA__ABI23979
MEKIVLLLAIISLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEESRLKREEISGVKLESIGTYQILSIYSTVASSLALAIMVAGLSLWMCSNGSLQCRICI

SEQ ID NO: 1237 - protein, 566 aa, Artificial Sequence; identical to SEQ ID NO: 282
  hemagglutinin__InfluenzaA__ABI26646

SEQ ID NO: 1238 - protein, 566 aa, Artificial Sequence; identical to SEQ ID NO: 911
  hemagglutinin__InfluenzaA__ABI30367

SEQ ID NO: 1239 - protein, 566 aa, Artificial Sequence; identical to SEQ ID NO: 921
  hemagglutinin__InfluenzaA__ABI30378

SEQ ID NO: 1240 - protein, 566 aa, Artificial Sequence; identical to SEQ ID NO: 650
  hemagglutinin__InfluenzaA__ABI30400

SEQ ID NO: 1241 - protein, 566 aa, Artificial Sequence
  hemagglutinin__InfluenzaA__ABI30411
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMDKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1242 - protein, 566 aa, Artificial Sequence; identical to SEQ ID NO: 591
  hemagglutinin__InfluenzaA__ABI30422

SEQ ID NO: 1243 - protein, 566 aa, Artificial Sequence; identical to SEQ ID NO: 282
  hemagglutinin__InfluenzaA__ABI30433

SEQ ID NO: 1244 - protein, 566 aa, Artificial Sequence; identical to SEQ ID NO: 591
  hemagglutinin__InfluenzaA__ABI30444

SEQ ID NO: 1245 - protein, 566 aa, Artificial Sequence; identical to SEQ ID NO: 282
  hemagglutinin__InfluenzaA__ABI30455

SEQ ID NO: 1246 - protein, 566 aa, Artificial Sequence; identical to SEQ ID NO: 282
  hemagglutinin__InfluenzaA__ABI30466

SEQ ID NO: 1247 - protein, 566 aa, Artificial Sequence; identical to SEQ ID NO: 282
  hemagglutinin__InfluenzaA__ABI30477

SEQ ID NO: 1248 - protein, 566 aa, Artificial Sequence; identical to SEQ ID NO: 282
  hemagglutinin__InfluenzaA__ABI30488

SEQ ID NO: 1249 - protein, 566 aa, Artificial Sequence; identical to SEQ ID NO: 282
  hemagglutinin__InfluenzaA__ABI30499

SEQ ID NO: 1250 - protein, 566 aa, Artificial Sequence; identical to SEQ ID NO: 243
  hemagglutinin__InfluenzaA__ABI30510

SEQ ID NO: 1251 - protein, 566 aa, Artificial Sequence
  hemagglutinin__InfluenzaA__ABI30521
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIGSRPRVRDIPSRISIYWTIVKPGDILLINSTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1252 - protein, 566 aa, Artificial Sequence; identical to SEQ ID NO: 282
  hemagglutinin__InfluenzaA__ABI30532

SEQ ID NO: 1253 - protein, 566 aa, Artificial Sequence; identical to SEQ ID NO: 1113
  hemagglutinin__InfluenzaA__ABI30543

SEQ ID NO: 1254 - protein, 566 aa, Artificial Sequence; identical to SEQ ID NO: 282
  hemagglutinin__InfluenzaA__ABI30554

SEQ ID NO: 1255 - protein, 565 aa, Artificial Sequence; identical to SEQ ID NO: 1204
  hemagglutinin__InfluenzaA__ABI30565

SEQ ID NO: 1256 - protein, 566 aa, Artificial Sequence; identical to SEQ ID NO: 633
  hemagglutinin__InfluenzaA__ABI30587

SEQ ID NO: 1257 - protein, 566 aa, Artificial Sequence
  hemagglutinin__InfluenzaA__ABI30609
MKTIIALSYILCLVFAQKLPGNDNSTATLCLGHHAVPNGTIVKTIMNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1258 - protein, 566 aa, Artificial Sequence
  hemagglutinin__InfluenzaA__ABI30620
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFIERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKVDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1259 - protein, 566 aa, Artificial Sequence; identical to SEQ ID NO: 633
  hemagglutinin__InfluenzaA__ABI30733

SEQ ID NO: 1260 - protein, 566 aa, Artificial Sequence; identical to SEQ ID NO: 633
  hemagglutinin__InfluenzaA__ABI30744

SEQ ID NO: 1261 - protein, 566 aa, Artificial Sequence; identical to SEQ ID NO: 633
  hemagglutinin__InfluenzaA__ABI30755

SEQ ID NO: 1262 - protein, 566 aa, Artificial Sequence; identical to SEQ ID NO: 633
  hemagglutinin__InfluenzaA__ABI30766

SEQ ID NO: 1263 - protein, 566 aa, Artificial Sequence; identical to SEQ ID NO: 633
  hemagglutinin__InfluenzaA__ABI30777

SEQ ID NO: 1264 - protein, 566 aa, Artificial Sequence
  hemagglutinin__InfluenzaA__ABI30788
MKTIIALSYILCLVFAQKLSGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1265 - protein, 566 aa, Artificial Sequence; identical to SEQ ID NO: 633
  hemagglutinin__InfluenzaA__ABI30799

SEQ ID NO: 1266 - protein, 566 aa, Artificial Sequence
  hemagglutinin__InfluenzaA__ABI30810
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIKNGTYDHDVYRDEALNNRFQIKGVELKSGYKDWILWISFAISCFLLCVALLGFIMWACQKGNIRCNICI

SEQ ID NO: 1267 - protein, 566 aa, Artificial Sequence
  hemagglutinin__InfluenzaA__ABI30821
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVAMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1268 - protein, 566 aa, Artificial Sequence; identical to SEQ ID NO: 633
  hemagglutinin__InfluenzaA__ABI30832

SEQ ID NO: 1269 - protein, 566 aa, Artificial Sequence
  hemagglutinin__InfluenzaA__ABI30843
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1270 - protein, 566 aa, Artificial Sequence; identical to SEQ ID NO: 1213
  hemagglutinin__InfluenzaA__ABI30865

SEQ ID NO: 1271 - protein, 568 aa, Artificial Sequence
  hemagglutinin__InfluenzaA__ABI36155
MEKIVLLLATVSLVKSDQICIGYHANNSTEQVDTIMEKNVTVTHAQDILEKTHNGKLCDLDGVKPLILRDCSVAGWLLGNPMCDEFINVPEWSYIVEKANPANGLCYPGNFNDYEELKHLLSRINHFEKLQIIPKSSWSDHEASLGVSSACPYLGRSSFFRNVVWLIKKNNTYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGDCNTKCQTPMGAINSSMPLHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGIYQILSIYSTVASSLALAIMMAGLSLWMCSNGSLQCRVCI

SEQ ID NO: 1272 - protein, 568 aa, Artificial Sequence
  hemagglutinin__InfluenzaA__ABI36166
MEKIVLLLATVSLVKSDQICIGYHANNSTEQVDTIMEKNVTVTHAQDILEKTHNGKLCDLDGVKPLILRDCSVAGWLLGNPMCDEFINVPEWSYIVEKANPANGLCYPGNFNDYEELKHLLSRINHFEKLQIIPKSSWSDHEASLGVSSACPYLGRSSFFRNVVWLIKKNNTYPTIKRSYNNTNQEDLLVLWGIHHPNDAAEQTRLYQNPTTYISVGTSTLNQRLVPKIATRSKVNGQSGRMEFFWTILKPNDAINFESNGNFIAPEYAYKIVKKGDSAIMKSELEYGDCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGIYQILSIYSTVASSLALAIMMAGLSLWMCSNGSLQCRVCI

SEQ ID NO: 1273 - protein, 568 aa, Artificial Sequence; identical to SEQ ID NO: 1272
  hemagglutinin__InfluenzaA__ABI36177

SEQ ID NO: 1274 - protein, 568 aa, Artificial Sequence
  hemagglutinin__InfluenzaA__ABI36406
MEKIVLLLATVSLVKSDQICIGYHANNSTEQVDTIMEKNVTVTHAQDILEKTHNGKLCDLDGVKPLILRDCSVAGWLLGNPMCDEFINVPEWSYIVEKANPANGLCYPGNFNDYEELKHLLSRINHFEKLQIIPKSSWSDHEASLGVSSACPYLGRSSFFRNVVWLIKKNNTYPTIKRSYNNTNQEDLLVLWGLHHPNDAAEQTRLYQNPTTYISVGTSTLNQRLVPKIATRSKVNGQSGRMEFFWTILKPNDAINFESNGNFIAPEYAYKIVKKGDSAIMKSELEYGDCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGIYQILSIYSTVASSLALAIMMAGLSLWMCSNGSLQCRVCI

SEQ ID NO: 1275 - protein, 568 aa, Artificial Sequence
  hemagglutinin__InfluenzaA__ABI36450
MEKIVLLLAIVSLVKSDQICIGYHANNSTEQVDTIMEKNVTVTHAQDILGKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKTSYNNTNQEDLLVLWGIHHSNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1276 - protein, 568 aa, Artificial Sequence
  hemagglutinin__InfluenzaA__ABI49396
MEKIVLLLAIVSLVKSDQICIGYHANNSTEQVDTIMEKNVTVTHAQDILGKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWAILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1277 - protein, 567 aa, Artificial Sequence
  hemagglutinin__InfluenzaA__ABI85000
MNTQILAFIACMLIGTKGDKICLGHHAVANGTKVNTLTERGIEVVNATETVETVNIKKICTQGKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKQAYQKRMTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 1278 - protein, 566 aa, Artificial Sequence; identical to SEQ ID NO: 830
  hemagglutinin__InfluenzaA__ABI92291

SEQ ID NO: 1279 - protein, 566 aa, Artificial Sequence
  hemagglutinin__InfluenzaA__ABI92302
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHNVTRGVTASCSHKGKSSFYRNLLWLTEKNGSYPNLSKSYVNNKEKEVLVLWGVHHPSNIEDQKTIYRKENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNIQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1280 - protein, 566 aa, Artificial Sequence
  hemagglutinin__InfluenzaA__ABI92313
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSISSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEITKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYHILAIYSTVASSLVLLVSLGAISFWMCSNGSLQCRICI

SEQ ID NO: 1281 - protein, 566 aa, Artificial Sequence
  hemagglutinin__InfluenzaA__ABI92324
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGKVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1282 - protein, 566 aa, Artificial Sequence
  hemagglutinin__InfluenzaA__ABI92335
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACMGSIRNGTYDHDVYRDEALNNRFQIKGVELKSGYKDWILWISFAISCFLLCIVLMGFIMWACQKGNIRCNICI

SEQ ID NO: 1283 - protein, 566 aa, Artificial Sequence
  hemagglutinin__InfluenzaA__ABI92346
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFHIKGVELKSGYKDWVLWISFAISCFLLCIVLLGFIMWACQKGNIRCNICI

SEQ ID NO: 1284 - protein, 566 aa, Artificial Sequence; identical to SEQ ID NO: 282
  hemagglutinin__InfluenzaA__ABI92357

SEQ ID NO: 1285 - protein, 566 aa, Artificial Sequence; identical to SEQ ID NO: 282
  hemagglutinin__InfluenzaA__ABI92368

SEQ ID NO: 1286 - protein, 565 aa, Artificial Sequence; identical to SEQ ID NO: 1204
  hemagglutinin__InfluenzaA__ABI92379

SEQ ID NO: 1287 - protein, 566 aa, Artificial Sequence
  hemagglutinin__InfluenzaA__ABI92390
MKTIIAFSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQTSLYAQASGRITVSTKRSQQTVTPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1288 - protein, 566 aa, Artificial Sequence; identical to SEQ ID NO: 282
  hemagglutinin__InfluenzaA__ABI92401

SEQ ID NO: 1289 - protein, 566 aa, Artificial Sequence
  hemagglutinin__InfluenzaA__ABI92412
MKTIIALSYILCLVFAQKLPGNDNSTATLCLGHHAVPNGTLVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNINRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1290 - protein, 566 aa, Artificial Sequence
  hemagglutinin__InfluenzaA__ABI92423
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPDKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1291 - protein, 566 aa, Artificial Sequence; identical to SEQ ID NO: 633
  hemagglutinin__InfluenzaA__ABI92434

SEQ ID NO: 1292 - protein, 566 aa, Artificial Sequence
  hemagglutinin__InfluenzaA__ABI92445
MKTIIALSYILCLVFTQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVNQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNTCIGSIRNGTYDHDVYRDEALNNRFQIKGVELKSGYKDWILWISFAISCFLLCVALLGFIMWACQKGNIRCNICI

SEQ ID NO: 1293 - protein, 566 aa, Artificial Sequence; identical to SEQ ID NO: 633
  hemagglutinin__InfluenzaA__ABI92456

SEQ ID NO: 1294 - protein, 566 aa, Artificial Sequence; identical to SEQ ID NO: 1241
  hemagglutinin__InfluenzaA__ABI92467

SEQ ID NO: 1295 - protein, 566 aa, Artificial Sequence; identical to SEQ ID NO: 650
  hemagglutinin__InfluenzaA__ABI92478

SEQ ID NO: 1296 - protein, 566 aa, Artificial Sequence; identical to SEQ ID NO: 1241
  hemagglutinin__InfluenzaA__ABI92489

SEQ ID NO: 1297 - protein, 566 aa, Artificial Sequence
  hemagglutinin__InfluenzaA__ABI92500
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAVINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1298 - protein, 566 aa, Artificial Sequence
  hemagglutinin__InfluenzaA__ABI92511
MKTIIALSYILCLVFAQKLPGNDNSTATLCLGHHAVPNGTLVKTITNDQIEVTNATELVQNSSTGIICDSPHQILDGENCTLIDALLGDPHCDGFQNKEWDLFVERSKAYSNCYPYDVPDYASLRSLVASSGTLEFNNESFNWTGVAQNGTSSACKRRSDKSFFSRLNWLHQLKYKYPALNVTMPNTEKFDKLYIWGVHHPSTDSDQISLYAQASGRVTVSTKRSQQTVIPNIGSRPWVRGVSSRVSIYWTIVKPGDILLINSTGNLIAPRGYFKIRSGKSSIMRSDASIGKCNSKCITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNTCIGSIRNGTYDHDVYRDEALNNRFQIKGVELKSGYKDWILWISFAISCFLLCVVLLGFIMWACQKGNIRCNICI

SEQ ID NO: 1299 - protein, 566 aa, Artificial Sequence
  hemagglutinin__InfluenzaA__ABI92522
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSNKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1300 - protein, 566 aa, Artificial Sequence
  hemagglutinin__InfluenzaA__ABI92533
MKTIIALSYILCLVFAQKLPGNDNSRATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1301 - protein, 566 aa, Artificial Sequence; identical to SEQ ID NO: 1300
  hemagglutinin__InfluenzaA__ABI92544

SEQ ID NO: 1302 - protein, 566 aa, Artificial Sequence
  hemagglutinin__InfluenzaA__ABI92577
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSRAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSKISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1303 - protein, 566 aa, Artificial Sequence; identical to SEQ ID NO: 1039
  hemagglutinin__InfluenzaA__ABI92588

SEQ ID NO: 1304 - protein, 566 aa, Artificial Sequence
  hemagglutinin__InfluenzaA__ABI92599
MKTIIALSYILCLVFAQKLPGNDNSTATLCLGHHAVPNGTLVKTITNDQIEVTNATELVQSSSTGRICNSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQKTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1305 - protein, 566 aa, Artificial Sequence
  hemagglutinin__InfluenzaA__ABI92610
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1306 - protein, 566 aa, Artificial Sequence
  hemagglutinin__InfluenzaA__ABI92621
MKTIIALSYILCLVFAQKLPGNDNSMATLCLGHHAVPNGTLVKTITNDQIEVTNATELVQSSSTGRICNSPHQILDGENCTLIDALLGDPHCEGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSKISIYWTIVKPGDILLINSTGNLIAPRGYFKIRSGKSSIMRSDAPIDKCNSECITPNGSIPNDKPFQNVNRITYGLCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1307 - protein, 566 aa, Artificial Sequence; identical to SEQ ID NO: 562
  hemagglutinin__InfluenzaA__ABI92632

SEQ ID NO: 1308 - protein, 566 aa, Artificial Sequence
  hemagglutinin__InfluenzaA__ABI92643
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTIPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKRQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1309 - protein, 566 aa, Artificial Sequence
  hemagglutinin__InfluenzaA__ABI92665
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRGSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKRQLRENAEDMGNGCFKIYHKCDNACIGSIRNGTYDHDVYRNEALNNRFQIKGVELKSGYKDWILWISFAISCFLLCVALLGFIMWACQKGNIRCNICI

SEQ ID NO: 1310 - protein, 566 aa, Artificial Sequence
  hemagglutinin__InfluenzaA__ABI92676
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRNGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1311 - protein, 566 aa, Artificial Sequence
  hemagglutinin__InfluenzaA__ABI92687
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRGSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKRQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1312 - protein, 566 aa, Artificial Sequence; identical to SEQ ID NO: 1311
  hemagglutinin__InfluenzaA__ABI92698

SEQ ID NO: 1313 - protein, 566 aa, Artificial Sequence; identical to SEQ ID NO: 516
  hemagglutinin__InfluenzaA__ABI92709

SEQ ID NO: 1314 - protein, 566 aa, Artificial Sequence
  hemagglutinin__InfluenzaA__ABI92720
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTESDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1315 - protein, 566 aa, Artificial Sequence
  hemagglutinin__InfluenzaA__ABI92731
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKRQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1316 - protein, 566 aa, Artificial Sequence
  hemagglutinin__InfluenzaA__ABI92742
MKTIIALSYILCLVFSQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1317 - protein, 566 aa, Artificial Sequence
  hemagglutinin__InfluenzaA__ABI92753
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYAYLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKRQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1318 - protein, 566 aa, Artificial Sequence
  hemagglutinin__InfluenzaA__ABI92764
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFDWTGVTQNGTSSACKRGSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKRQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1319 - protein, 566 aa, Artificial Sequence; identical to SEQ ID NO: 1311
  hemagglutinin__InfluenzaA__ABI92775

SEQ ID NO: 1320 - protein, 566 aa, Artificial Sequence; identical to SEQ ID NO: 243
  hemagglutinin__InfluenzaA__ABI92786

SEQ ID NO: 1321 - protein, 566 aa, Artificial Sequence
  hemagglutinin__InfluenzaA__ABI92797
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVISNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1322 - protein, 566 aa, Artificial Sequence; identical to SEQ ID NO: 243
  hemagglutinin__InfluenzaA__ABI92808

SEQ ID NO: 1323 - protein, 566 aa, Artificial Sequence; identical to SEQ ID NO: 243
  hemagglutinin__InfluenzaA__ABI92819

SEQ ID NO: 1324 - protein, 566 aa, Artificial Sequence; identical to SEQ ID NO: 243
  hemagglutinin__InfluenzaA__ABI92841

SEQ ID NO: 1325 - protein, 566 aa, Artificial Sequence
  hemagglutinin__InfluenzaA__ABI92852
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGYRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1326 - protein, 566 aa, Artificial Sequence
  hemagglutinin__InfluenzaA__ABI92863
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAHSNCYPYDVPDYASLRSLIASSGTLEFNNESFNWTGVTQNGTSSACKRRSNQSFFSRLNWLTHLKFKYPALNVTMPNNEKFDKLYIWGVHHPGTDSDQISLYAQAPGRITVSTKRSQQTVIPNIGSRPRVRDISSRISIYWTIVKPGDILLINSTGNLIAPRGYFKIRSGKSSIMKSDAPIGRCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCLLLCVALLGFIMWACQKGNIRCNICI

SEQ ID NO: 1327 - protein, 566 aa, Artificial Sequence; identical to SEQ ID NO: 243
  hemagglutinin__InfluenzaA__ABI92874

SEQ ID NO: 1328 - protein, 566 aa, Artificial Sequence; identical to SEQ ID NO: 243
  hemagglutinin__InfluenzaA__ABI92885

SEQ ID NO: 1329 - protein, 566 aa, Artificial Sequence
  hemagglutinin__InfluenzaA__ABI92907
MKTIIALSYILCLVFAQKLPGNDNSTATLCLGHHAVPNGTIVKTITNDQIEVTNATELVQSSSTGGICDSPYQILDGENCTLIDALLGDPQCDGFQNKKWDLFVERSKAYSNCYPYDVPDYVSLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1330 - protein, 566 aa, Artificial Sequence; identical to SEQ ID NO: 243
  hemagglutinin__InfluenzaA__ABI92918

SEQ ID NO: 1331 - protein, 566 aa, Artificial Sequence; identical to SEQ ID NO: 1329
  hemagglutinin__InfluenzaA__ABI92929

SEQ ID NO: 1332 - protein, 566 aa, Artificial Sequence
  hemagglutinin__InfluenzaA__ABI92940
MKTIIAFNYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNEIFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1333 - protein, 566 aa, Artificial Sequence
  hemagglutinin__InfluenzaA__ABI92951
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNSCIGSIRNGTYDHDVYRDEALNNRFQIKGVELKSGYKDWILWISFAISCFLLCVALLGFIMWACQKGNIRCNICI

SEQ ID NO: 1334 - protein, 566 aa, Artificial Sequence
  hemagglutinin__InfluenzaA__ABI92962
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERNKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1335 - protein, 566 aa, Artificial Sequence; identical to SEQ ID NO: 633
  hemagglutinin__InfluenzaA__ABI92973

SEQ ID NO: 1336 - protein, 566 aa, Artificial Sequence; identical to SEQ ID NO: 633
  hemagglutinin__InfluenzaA__ABI92984

SEQ ID NO: 1337 - protein, 566 aa, Artificial Sequence
  hemagglutinin__InfluenzaA__ABI92995
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRIRDIPSRISIYWTIVKPGDILLINSTGNLIAPRGYFKIRSGKSSIMRSDAPIGKCNSECITPNGSIPNDKPFQNVNRITYGACPKYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1338 - protein, 566 aa, Artificial Sequence; identical to SEQ ID NO: 633
  hemagglutinin__InfluenzaA__ABI93006

SEQ ID NO: 1339 - protein, 566 aa, Artificial Sequence; identical to SEQ ID NO: 633
  hemagglutinin__InfluenzaA__ABI93017

SEQ ID NO: 1340 - protein, 565 aa, Artificial Sequence; identical to SEQ ID NO: 1232
  hemagglutinin__InfluenzaA__ABI93028

SEQ ID NO: 1341 - protein, 566 aa, Artificial Sequence; identical to SEQ ID NO: 966
  hemagglutinin__InfluenzaA__ABI93039

SEQ ID NO: 1342 - protein, 566 aa, Artificial Sequence
  hemagglutinin__InfluenzaA__ABI93061
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1343 - protein, 566 aa, Artificial Sequence; identical to SEQ ID NO: 650
  hemagglutinin__InfluenzaA__ABI93072

SEQ ID NO: 1344 - protein, 566 aa, Artificial Sequence; identical to SEQ ID NO: 650
  hemagglutinin__InfluenzaA__ABI93083

SEQ ID NO: 1345 - protein, 566 aa, Artificial Sequence; identical to SEQ ID NO: 650
  hemagglutinin__InfluenzaA__ABI93094

SEQ ID NO: 1346 - protein, 566 aa, Artificial Sequence; identical to SEQ ID NO: 650
  hemagglutinin__InfluenzaA__ABI93105

SEQ ID NO: 1347 - protein, 566 aa, Artificial Sequence
  hemagglutinin__InfluenzaA__ABI93116
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKMRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHGVYRDEALNNRFQIKGVELKSGYKDWILWISFAISCFLLCVVLLGFIMWACQKGNIRCNICI

SEQ ID NO: 1348 - protein, 562 aa, Artificial Sequence
  hemagglutinin__InfluenzaA__ABI94581
MNTQILVFALVASIPTNADKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLATGMKNVPEIPKRRRRGLFGAIAGFIENGWEGLIDGWYGFRHQNAQGEGTAADYKSTQSAIDQITGKLNRLIEKTNQQFELIDNEFTEVEKQIGNVINWTRDSMTEVWSYNAELLVAMENQHTIDLADSEMNKLYERVKRQLRENAEEDGTGCFEIFHKCDDDCMASIRNNTYDHSKYREEAIQNRIQIDPVKLSSGYKDVILWFSFGASCFILLAIAMGLVFICVKNGNMRCTICI

SEQ ID NO: 1349 - protein, 566 aa, Artificial Sequence; identical to SEQ ID NO: 766
  hemagglutinin__InfluenzaA__ABI95228

SEQ ID NO: 1350 - protein, 566 aa, Artificial Sequence
  hemagglutinin__InfluenzaA__ABI95239
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVNGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1351 - protein, 565 aa, Artificial Sequence
  hemagglutinin__InfluenzaA__ABI95250
MKAKLLVLLCTFTATYADTICVGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIGDQRAIYHTENAYVSVVSSHYSRRFTPEIAKRPKVRGQEGRINYYWTLLEPGDTIIFEANGNLIAPWYAFALSRGFGSGIITSNAPMNECDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1352 - protein, 565 aa, Artificial Sequence
  hemagglutinin__InfluenzaA__ABI95261
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIGVQRAIYHTENAYVSVVSSHYSRRFTPEIAKRPKVRDQEGRINYYWTLLEPGDTIIFEANGNLIAPWYAFALSRGFESGIITSNAPMNECDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1353 - protein, 565 aa, Artificial Sequence; identical to SEQ ID NO: 1232
  hemagglutinin__InfluenzaA__ABI95272

SEQ ID NO: 1354 - protein, 565 aa, Artificial Sequence; identical to SEQ ID NO: 1232
  hemagglutinin__InfluenzaA__ABI95283

SEQ ID NO: 1355 - protein, 565 aa, Artificial Sequence; identical to SEQ ID NO: 296
  hemagglutinin__InfluenzaA__ABI95294

SEQ ID NO: 1356 - protein, 565 aa, Artificial Sequence
  hemagglutinin__InfluenzaA__ABI96104
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLIKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 1357 - protein, 566 aa, Artificial Sequence; identical to SEQ ID NO: 650
  hemagglutinin__InfluenzaA__ABJ09107

SEQ ID NO: 1358 - protein, 566 aa, Artificial Sequence
  hemagglutinin__InfluenzaA__ABJ09140
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYSCKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1359 - protein, 565 aa, Artificial Sequence
  hemagglutinin__InfluenzaA__ABJ09151
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKGKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 1360 - protein, 566 aa, Artificial Sequence
  hemagglutinin__InfluenzaA__ABJ09162
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAEILVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1361 - protein, 566 aa, Artificial Sequence; identical to SEQ ID NO: 243
  hemagglutinin__InfluenzaA__ABJ09173

SEQ ID NO: 1362 - protein, 565 aa, Artificial Sequence
  hemagglutinin__InfluenzaA__ABJ09184
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEAGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1363 - protein, 566 aa, Artificial Sequence; identical to SEQ ID NO: 633
  hemagglutinin__InfluenzaA__ABJ09195

SEQ ID NO: 1364 - protein, 566 aa, Artificial Sequence; identical to SEQ ID NO: 633
  hemagglutinin__InfluenzaA__ABJ09206

SEQ ID NO: 1365 - protein, 566 aa, Artificial Sequence; identical to SEQ ID NO: 1213
  hemagglutinin__InfluenzaA__ABJ09217

SEQ ID NO: 1366 - protein, 566 aa, Artificial Sequence; identical to SEQ ID NO: 650
  hemagglutinin__InfluenzaA__ABJ09228

SEQ ID NO: 1367 - protein, 566 aa, Artificial Sequence
  hemagglutinin__InfluenzaA__ABJ09239
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTMEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1368 - protein, 566 aa, Artificial Sequence
  hemagglutinin__InfluenzaA__ABJ09250
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGIHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNETYDHDVYRDEALNNRFQIKGVELKSGYKDWILWISFAISCFLLCVVLLGFIMWACQKGNIRCNICI

SEQ ID NO: 1369 - protein, 566 aa, Artificial Sequence
  hemagglutinin__InfluenzaA__ABJ09261
MKTIIALSYILCLVFAQKLPGNDNSTATLCLGHHAVPNGTLVKTITNDQIEVTNATELVQSSSTGKICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKYHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1370 - protein, 566 aa, Artificial Sequence
  hemagglutinin__InfluenzaA__ABJ09272
MKTIIALSYILCLVFAQKLPGNDNSTATLCLGHHAVPNGTLVKTITNDQIEVTNATELVQSSSTGRICNSPHQILDGENCTLIDALLGDPHCDGFQNKEWDLFVERRKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKDVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1371 - protein, 566 aa, Artificial Sequence; identical to SEQ ID NO: 72
  hemagglutinin__InfluenzaA__ABJ09294

SEQ ID NO: 1372 - protein, 566 aa, Artificial Sequence
  hemagglutinin__InfluenzaA__ABJ09305
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNETYDHDVYRDEALNNRFQIKGVELKSGYKDWILWISFAISCFLLCVVLLGFIMWACQKGNIRCNICI

SEQ ID NO: 1373 - protein, 566 aa, Artificial Sequence
  hemagglutinin__InfluenzaA__ABJ09316
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRHWVRGVSSRISIYWTIVKPGDILLINSTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1374 - protein, 566 aa, Artificial Sequence; identical to SEQ ID NO: 650
  hemagglutinin__InfluenzaA__ABJ09338

SEQ ID NO: 1375 - protein, 566 aa, Artificial Sequence
  hemagglutinin__InfluenzaA__ABJ09349
MKTIIALSYILCLVFAQKLPGNDNSTATLCLGHHAVPNGTLVKTITNDQIEVTNATELIQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1376 - protein, 566 aa, Artificial Sequence; identical to SEQ ID NO: 650
  hemagglutinin__InfluenzaA__ABJ09360

SEQ ID NO: 1377 - protein, 566 aa, Artificial Sequence
  hemagglutinin__InfluenzaA__ABJ09371
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRLRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1378 - protein, 566 aa, Artificial Sequence; identical to SEQ ID NO: 633
  hemagglutinin__InfluenzaA__ABJ09382

SEQ ID NO: 1379 - protein, 566 aa, Artificial Sequence
  hemagglutinin__InfluenzaA__ABJ16587
MKTIIALSYISCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYRYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1380 - protein, 566 aa, Artificial Sequence
  hemagglutinin__InfluenzaA__ABJ16598
MKTIIALSYILCLVFAQKLPGNDNSTATLCLGHHAVPNGTLVKTITNDQIEVTNATELVQSSSTGRICNSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1381 - protein, 566 aa, Artificial Sequence
  hemagglutinin__InfluenzaA__ABJ16620
MKTIIALSYILCLVFAQKLPGNDNSTATLCLGHHAVPNGTLVKTITNDQIEVTNATELVQSSSTGRICNSPHQILDGENCTLIDALLGDPHCDGFQNKEWDLFVERNKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNKKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1382 - protein, 566 aa, Artificial Sequence
  hemagglutinin__InfluenzaA__ABJ16631
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1383 - protein, 565 aa, Artificial Sequence
  hemagglutinin__InfluenzaA__ABJ16664
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGHFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNRERIDGVKLESMGVYQILAIYSTVASSLVLLVSLGAISFWMCSNGSLQCRICI

SEQ ID NO: 1384 - protein, 565 aa, Artificial Sequence; identical to SEQ ID NO: 1204
  hemagglutinin__InfluenzaA__ABJ16675

SEQ ID NO: 1385 - protein, 565 aa, Artificial Sequence
  hemagglutinin__InfluenzaA__ABJ16686
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1386 - protein, 566 aa, Artificial Sequence
  hemagglutinin__InfluenzaA__ABJ16697
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCAVLLGFIMWACQKGNIRCNICI

SEQ ID NO: 1387 - protein, 566 aa, Artificial Sequence
  hemagglutinin__InfluenzaA__ABJ16730
MKAKLLVLLCAFTATYADTICIGYHANNSTDTVDTVLEKNVTVTHSVNLLEDSHNGKLCRLKGTAPLQLGNCSIAGWILGNPECESLFSKESWSYIAETPNPKNGTCYPGYFADYEELREQLSSVSSFERFEIFPKDSSWPNHTVTKGVTASCSHNGKSSFYKNLLWLTEKNGLYPNLSKSYVNKKGKEVLVLWGVHHPSNMGDQRAIYHKENAYVSVLSSHYSRRFTPEIARRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 1388 - protein, 566 aa, Artificial Sequence
  hemagglutinin__InfluenzaA__ABJ16741
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKGFFSRLNWLHQLKYKYPALNVTMPNNEKFDKLYIWGVHHPSTDSDQISLYAQAPGRVTVSTKRSQQTVIPNIGSRPWVRGVSSIISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1389 - protein, 566 aa, Artificial Sequence
  hemagglutinin__InfluenzaA__ABJ16752
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSGISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1390 - protein, 566 aa, Artificial Sequence
  hemagglutinin__InfluenzaA__ABJ16763
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRHWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1391 - protein, 566 aa, Artificial Sequence
  hemagglutinin__InfluenzaA__ABJ16774
MKTIIALSYILCLVFAQKLPVNDNSTATLCLGHHAVPNGTLVKTITNDHIEVTNATELVQSSPTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSGPWVRGVSSRISIYWTIVKPGDILLINSTGNLIAPRGYFKIRNGKSSIMRSNTPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1392 - protein, 566 aa, Artificial Sequence
  hemagglutinin__InfluenzaA__ABJ16785
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSYACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1393 - protein, 566 aa, Artificial Sequence; identical to SEQ ID NO: 910
  hemagglutinin__InfluenzaA__ABJ53438

SEQ ID NO: 1394 - protein, 565 aa, Artificial Sequence; identical to SEQ ID NO: 742
  hemagglutinin__InfluenzaA__ABJ53449

SEQ ID NO: 1395 - protein, 566 aa, Artificial Sequence
  hemagglutinin__InfluenzaA__ABJ53471
MKTIIALSYILCLVFAQKIPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1396 - protein, 566 aa, Artificial Sequence
  hemagglutinin__InfluenzaA__ABJ53482
MKTIIALSYILCLVFAQKLPGNDNSTATLCLGHHAVPNGTIVRTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1397 - protein, 565 aa, Artificial Sequence; identical to SEQ ID NO: 1232
  hemagglutinin__InfluenzaA__ABJ53493

SEQ ID NO: 1398 - protein, 565 aa, Artificial Sequence
  hemagglutinin__InfluenzaA__ABJ53504
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTEKNGLYPNLSKSYVNNKEKEVLVLWGVHHPSNIGVQRAIYHTENAYVSVVSSHYSRRFTPEIAKRPKVRDQEGRINYYWTLLEPGDTIIFEANGNLIAPWYAFALSRGFESGIITSNAPMNECDAKCQTPLGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1399 - protein, 566 aa, Artificial Sequence; identical to SEQ ID NO: 1387
  hemagglutinin__InfluenzaA__ABJ53515

SEQ ID NO: 1400 - protein, 566 aa, Artificial Sequence
  hemagglutinin__InfluenzaA__ABK39962
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQKTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1401 - protein, 566 aa, Artificial Sequence; identical to SEQ ID NO: 630
  hemagglutinin__InfluenzaA__ABK39973

SEQ ID NO: 1402 - protein, 566 aa, Artificial Sequence
  hemagglutinin__InfluenzaA__ABK39984
MKTIIALSYILCLVFAQKLPGNDNSRATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1403 - protein, 565 aa, Artificial Sequence
  hemagglutinin__InfluenzaA__ABK39995
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVYSFERFEIFPKESSWPNHTVTGVSASCSHNGKSSFYRNLLWLTGKNGLYPNLSKSYANNKEKEVLILWGVHHPPNIGNQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 1404 - protein, 566 aa, Artificial Sequence
  hemagglutinin__InfluenzaA__ABK40017
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNKKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1405 - protein, 566 aa, Artificial Sequence
  hemagglutinin__InfluenzaA__ABK40028
MKAKLLVLLCAFTATYADTICIGYHANNSTDTVDTVLEKNVTVTHSVNLLEDSHNGKLCRLKGTAPLQLGNCSIAGWILGNPECESLFSKESWSYIAETPNPKNGTCYPGYFADYEELREQLSSVSSFERFEIFPKDSSWPNHTVTKGVTASCSHNGKSSFYKNLLWLTEKNGLYPNLSKSYVNKKGKEVLVLWGVHHPSNMGDQRAIYHKENAYVTVLSSHYSRRFTPEIARRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 1406 - protein, 566 aa, Artificial Sequence; identical to SEQ ID NO: 1387
  hemagglutinin__InfluenzaA__ABK40039

SEQ ID NO: 1407 - protein, 566 aa, Artificial Sequence; identical to SEQ ID NO: 1387
  hemagglutinin__InfluenzaA__ABK40050

SEQ ID NO: 1408 - protein, 566 aa, Artificial Sequence; identical to SEQ ID NO: 650
  hemagglutinin__InfluenzaA__ABK40061

SEQ ID NO: 1409 - protein, 566 aa, Artificial Sequence; identical to SEQ ID NO: 650
  hemagglutinin__InfluenzaA__ABK40075

SEQ ID NO: 1410 - protein, 566 aa, Artificial Sequence; identical to SEQ ID NO: 921
  hemagglutinin__InfluenzaA__ABK40510

SEQ ID NO: 1411 - protein, 566 aa, Artificial Sequence; identical to SEQ ID NO: 921
  hemagglutinin__InfluenzaA__ABK40534

SEQ ID NO: 1412 - protein, 566 aa, Artificial Sequence
  hemagglutinin__InfluenzaA__ABK40546
MKAKLLVLLCALSATDADTICIGYHANNSTDTVDTVLEKNVTVTHSVNLLEDNHNGKLCKLKGIAPLQLGKCSIAGWILGNPECESLFSNKSWSYIAETPNSENGTCYPGYFADYEELREQLSSVSSFERFEIFPKESSWPKHNVTKGVTASCSHKGKSSFYRNLLWLTEKNGSYPNLSKSYVNNKEKEVLVLWGVHHPSNIEDQKTIYRKENAYVSVVSSHYNRRFTPEIAKRPKVRNQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1413 - protein, 566 aa, Artificial Sequence; identical to SEQ ID NO: 921
  hemagglutinin__InfluenzaA__ABK40557

SEQ ID NO: 1414 - protein, 566 aa, Artificial Sequence; identical to SEQ ID NO: 921
  hemagglutinin__InfluenzaA__ABK40568

SEQ ID NO: 1415 - protein, 566 aa, Artificial Sequence; identical to SEQ ID NO: 921
  hemagglutinin__InfluenzaA__ABK40579

SEQ ID NO: 1416 - protein, 566 aa, Artificial Sequence
  hemagglutinin__InfluenzaA__ABK40590
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPKHNVTKGVTASCSHKGKSSFYRNLLWLTEKNGSYPNLSKSYVNNKEKEVLVLWGVHHPSNIEDQKTIYRKENAYVSVVSSHYNRRFTPEIAKRPKVRNQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1417 - protein, 566 aa, Artificial Sequence; identical to SEQ ID NO: 921
  hemagglutinin__InfluenzaA__ABK40601

SEQ ID NO: 1418 - protein, 566 aa, Artificial Sequence; identical to SEQ ID NO: 650
  hemagglutinin__InfluenzaA__ABK40612

SEQ ID NO: 1419 - protein, 566 aa, Artificial Sequence
  hemagglutinin__InfluenzaA__ABK40623
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRIAYGACPRYVKQNTLKLATGMRNVPEKQTRGIFGAIAGFIENGWEGMVDGWYGFRHLNSEGTGQAADLKSTQAAINQINGKLNRLIEKTNEKFHQIEKEFSEVEGRIQDLEKYVKDTKIDLWSYNAELLVALENQHTIDLTDSEMNKLFERTRKQLRENAEDVGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1420 - protein, 566 aa, Artificial Sequence; identical to SEQ ID NO: 984
  hemagglutinin__InfluenzaA__ABK40645

SEQ ID NO: 1421 - protein, 566 aa, Artificial Sequence
  hemagglutinin__InfluenzaA__ABK40656
MKTIIALSYILCLVFAQKLPGNDNSTATLCLGHHAVPNGTLVKTITNDQIEVTNATELVQSSPTGRICDSPHRILDGKNCTLIDALLGDPHCDGFQNKEWDLFVERSKAYSNCYPYDVPDYASLRSLVASSGTLEFTNENFNWTGVAQDGKSYSCKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGTCPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1422 - protein, 566 aa, Artificial Sequence
  hemagglutinin__InfluenzaA__ABK40667
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKLRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLTEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 1423 - protein, 566 aa, Artificial Sequence; identical to SEQ ID NO: 1066
  hemagglutinin__InfluenzaA__ABK40678

SEQ ID NO: 1424 - protein, 565 aa, Artificial Sequence
  hemagglutinin__InfluenzaA__ABK40689
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGNQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1425 - protein, 566 aa, Artificial Sequence; identical to SEQ ID NO: 650
  hemagglutinin__InfluenzaA__ABK40700

SEQ ID NO: 1426 - protein, 566 aa, Artificial Sequence; identical to SEQ ID NO: 650
  hemagglutinin__InfluenzaA__ABK40711

SEQ ID NO: 1427 - protein, 566 aa, Artificial Sequence
  hemagglutinin__InfluenzaA__ABK40722
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDNDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1428 - protein, 566 aa, Artificial Sequence; identical to SEQ ID NO: 650
  hemagglutinin__InfluenzaA__ABK40733

SEQ ID NO: 1429 - protein, 566 aa, Artificial Sequence; identical to SEQ ID NO: 1305
  hemagglutinin__InfluenzaA__ABK40744

SEQ ID NO: 1430 - protein, 566 aa, Artificial Sequence; identical to SEQ ID NO: 915
  hemagglutinin__InfluenzaA__ABK79948

SEQ ID NO: 1431 - protein, 565 aa, Artificial Sequence; identical to SEQ ID NO: 1204
  hemagglutinin__InfluenzaA__ABK79959

SEQ ID NO: 1432 - protein, 566 aa, Artificial Sequence
  hemagglutinin__InfluenzaA__ABK79970
MKAKLLVLLCAFTATYADTICIGYHANNSTDTVDTVLEKNVTVTHSVNLLEDSHNGKLCRLKGTAPLQLGNCSIAGWILGNPECESLFSKKSWSYIAETPNPKNGTCYPGYFADYEELREQLSSVSSFERFEIFPKDSSWPNHTVTKGVTASCSHNGKSSFYKNLLWLTEKNGLYPNLSKSYVNKKGKEVLVLWGVHHPSNMGDQRAIYHKENAYVSVLSSHYSRRFTPEIARRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 1433 - protein, 566 aa, Artificial Sequence
  hemagglutinin__InfluenzaA__ABK79981
MKTIIALSYILCLVFTQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1434 - protein, 566 aa, Artificial Sequence; identical to SEQ ID NO: 650
  hemagglutinin__InfluenzaA__ABK79992

SEQ ID NO: 1435 - protein, 566 aa, Artificial Sequence; identical to SEQ ID NO: 921
  hemagglutinin__InfluenzaA__ABK80025

SEQ ID NO: 1436 - protein, 566 aa, Artificial Sequence; identical to SEQ ID NO: 921
  hemagglutinin__InfluenzaA__ABK80036

SEQ ID NO: 1437 - protein, 566 aa, Artificial Sequence; identical to SEQ ID NO: 921
  hemagglutinin__InfluenzaA__ABK80047

SEQ ID NO: 1438 - protein, 566 aa, Artificial Sequence; identical to SEQ ID NO: 766
  hemagglutinin__InfluenzaA__ABK80058

SEQ ID NO: 1439 - protein, 566 aa, Artificial Sequence
  hemagglutinin__InfluenzaA__ABK80069
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWIRGVSSRISIYWTIVKPGDILLINSTGNLIAPRGYFKIRSGKSSIMRSNAPIGKCNSECITPNGSIPNDKPFQNVNRIAYGACPRYVKQNTLKLATGMRNVPEKQTRGIFGAIAGFIENGWEGMVDGWYGFRHLNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDVGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1440 - protein, 566 aa, Artificial Sequence
  hemagglutinin__InfluenzaA__ABK80080
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCLKIYHKCDNACIGSIRNGTYDHDVYRDEALNNRFQIKGVELKSGYKDWILWISFAISCFLLCVVLLGFIMWACQKGNIRCNICI

SEQ ID NO: 1441 - protein, 566 aa, Artificial Sequence; identical to SEQ ID NO: 650
  hemagglutinin__InfluenzaA__ABK80091

SEQ ID NO: 1442 - protein, 566 aa, Artificial Sequence; identical to SEQ ID NO: 650
  hemagglutinin__InfluenzaA__ABK80102

SEQ ID NO: 1443 - protein, 566 aa, Artificial Sequence; identical to SEQ ID NO: 51
  hemagglutinin__InfluenzaA__ABK80113

SEQ ID NO: 1444 - protein, 566 aa, Artificial Sequence
  hemagglutinin__InfluenzaA__ABK80124
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKNWILWISFAISCFLLCIVLLGFIMWACQKGNIRCNICI

SEQ ID NO: 1445 - protein, 566 aa, Artificial Sequence; identical to SEQ ID NO: 51
  hemagglutinin__InfluenzaA__ABK80135

SEQ ID NO: 1446 - protein, 566 aa, Artificial Sequence; identical to SEQ ID NO: 51
  hemagglutinin__InfluenzaA__ABK80146

SEQ ID NO: 1447 - protein, 566 aa, Artificial Sequence; identical to SEQ ID NO: 51
  hemagglutinin__InfluenzaA__ABK80157

SEQ ID NO: 1448 - protein, 566 aa, Artificial Sequence; identical to SEQ ID NO: 562
  hemagglutinin__InfluenzaA__ABK80168

SEQ ID NO: 1449 - protein, 566 aa, Artificial Sequence
  hemagglutinin__InfluenzaA__ABK80179
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSVPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRLQIKGVELKSGYKDWILWISFAISCFLLCIVLLGFIMWACQKGNIRCNICI

SEQ ID NO: 1450 - protein, 566 aa, Artificial Sequence; identical to SEQ ID NO: 562
  hemagglutinin__InfluenzaA__ABK80190

SEQ ID NO: 1451 - protein, 566 aa, Artificial Sequence; identical to SEQ ID NO: 1305
  hemagglutinin__InfluenzaA__ABK80201

SEQ ID NO: 1452 - protein, 566 aa, Artificial Sequence
  hemagglutinin__InfluenzaA__ABK80212
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKNWILWISFAISCFLLCVALLGFIMWACQKGNIRCNICI

SEQ ID NO: 1453 - protein, 566 aa, Artificial Sequence; identical to SEQ ID NO: 516
  hemagglutinin__InfluenzaA__ABK80223

SEQ ID NO: 1454 - protein, 566 aa, Artificial Sequence
  hemagglutinin__InfluenzaA__ABK80234
MRTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1455 - protein, 566 aa, Artificial Sequence
  hemagglutinin__InfluenzaA__ABK80245
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAHSNCYPYDVPDYASLRSLIASSGTLEFNNESFNWTGVTQNGTSSACKRRSNQSFFSRLNWLTHLKFKYPALNVTMPNNEKFDKLYIWGVHHPGTDSDQISLYAQAPGRITVSTKRSQQTVIPNIGSRPRVRDISSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCLLLCVALLGFIMWACQKGNIRCNICI

SEQ ID NO: 1456 - protein, 566 aa, Artificial Sequence; identical to SEQ ID NO: 1455
  hemagglutinin__InfluenzaA__ABK80256

SEQ ID NO: 1457 - protein, 566 aa, Artificial Sequence; identical to SEQ ID NO: 612
  hemagglutinin__InfluenzaA__ABK80267

SEQ ID NO: 1458 - protein, 566 aa, Artificial Sequence; identical to SEQ ID NO: 633
  hemagglutinin__InfluenzaA__ABK80278

SEQ ID NO: 1459 - protein, 566 aa, Artificial Sequence
  hemagglutinin__InfluenzaA__ABK80289
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1460 - protein, 566 aa, Artificial Sequence; identical to SEQ ID NO: 51
  hemagglutinin__InfluenzaA__ABK80300

SEQ ID NO: 1461 - protein, 566 aa, Artificial Sequence; identical to SEQ ID NO: 51
  hemagglutinin__InfluenzaA__ABK80311

SEQ ID NO: 1462 - protein, 568 aa, Artificial Sequence
  hemagglutinin__InfluenzaA__ABL07019
MEKIVLLLSIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLTKKNSTYPTIKKSYNNTNQEDLLVLWGIHHPNNEAEQTRLYQNPTTYISIGTSTLNQRLVPKIATRSKVNGQSGRMEFFWTILKPNDAINFESNGNFIAPEYAYKIVKKGDSAIMKSELEYSNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1463 - protein, 568 aa, Artificial Sequence
  hemagglutinin__InfluenzaA__ABL07030
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWAILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1464 - protein, 568 aa, Artificial Sequence
  hemagglutinin__InfluenzaA__ABL10088
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSEVNGQSGRMEFFWTILKPNDAINFESNGNFVAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAANKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 1465 - protein, 568 aa, Artificial Sequence
  hemagglutinin__InfluenzaA__ABL31766
MEKIVLLLAIVSFVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWAILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1466 - protein, 568 aa, Artificial Sequence
  hemagglutinin__InfluenzaA__ABL31780
MEKIVLLLSIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKGSWSDHEASSGVSSACPYLRSPSFFRNVVWLIKKNSTYPTIKKSYNNTNQEDLLVLWGIHHPNNEAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1467 - protein, 566 aa, Artificial Sequence
  hemagglutinin__InfluenzaA__ABL67165
MKTIIALSYILCLVFAQKLPGNDNSTATLCLGHHAVPNGTIVKTITNDQIEVTNATELVQSSSTSGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKKTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1468 - protein, 566 aa, Artificial Sequence
  hemagglutinin__InfluenzaA__ABL67176
MKTIIALSYILCLVFTQKLPGNDNSTATLCLGHHAVPNGTLVKTITNDQIEVTNATELVQSSSTGGICDSPHQILDGENCTLIDALLGDPHCDGFQNKEWDLFVERSRAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1469 - protein, 566 aa, Artificial Sequence; identical to SEQ ID NO: 1432
  hemagglutinin__InfluenzaA__ABL67187

SEQ ID NO: 1470 - protein, 566 aa, Artificial Sequence; identical to SEQ ID NO: 1387
  hemagglutinin__InfluenzaA__ABL67209

SEQ ID NO: 1471 - protein, 566 aa, Artificial Sequence; identical to SEQ ID NO: 921
  hemagglutinin__InfluenzaA__ABL67253

SEQ ID NO: 1472 - protein, 566 aa, Artificial Sequence
  hemagglutinin__InfluenzaA__ABL67264
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPKHNVTKGVTASCSHKGKSSFYRNLLWLTEKNGSYPNLSKSYVNNKEKEVLVLWGVHHPSNIEDQKTIYRKENAYVSVVSSHYNRRFTPEIAKRPKVRNQEGRINYYWTLLEPGDTIIFEANGNLIAPWYAFALSRGFGSGIITSNASMDECDAKCQTPQGAINSSFPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1473 - protein, 566 aa, Artificial Sequence
  hemagglutinin__InfluenzaA__ABL67275
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDVGNGCFKIYHKCDNACIGSIRNGTYDHDVYRDEALNNRFQIKGVKLKSGYKDWILWISFAISCFLLCVVLLGFIMWACQKGNIRCNICI

SEQ ID NO: 1474 - protein, 566 aa, Artificial Sequence
  hemagglutinin__InfluenzaA__ABL67286
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKSGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1475 - protein, 566 aa, Artificial Sequence; identical to SEQ ID NO: 1005
  hemagglutinin__InfluenzaA__ABL67297

SEQ ID NO: 1476 - protein, 566 aa, Artificial Sequence
  hemagglutinin__InfluenzaA__ABL67308
MKTIIALSYILCLVFAQKLPGNDNSMATLCLGHHAVPNGTLVKTITNDQIEVTNATELVQSSSTGRICDSPHQILDGENCTLIDALLGDPHCDGFQNKEWDLFVERSKAYSSCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIDKCNSECITPNGSIPNDKPFQNVNRITYGLCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNVRCNICI

SEQ ID NO: 1477 - protein, 566 aa, Artificial Sequence; identical to SEQ ID NO: 562
  hemagglutinin__InfluenzaA__ABL67319

SEQ ID NO: 1478 - protein, 566 aa, Artificial Sequence; identical to SEQ ID NO: 1305
  hemagglutinin__InfluenzaA__ABL67330

SEQ ID NO: 1479 - protein, 566 aa, Artificial Sequence; identical to SEQ ID NO: 516
  hemagglutinin__InfluenzaA__ABL67341

SEQ ID NO: 1480 - protein, 566 aa, Artificial Sequence; identical to SEQ ID NO: 516
  hemagglutinin__InfluenzaA__ABL67352

SEQ ID NO: 1481 - protein, 566 aa, Artificial Sequence; identical to SEQ ID NO: 32
  hemagglutinin__InfluenzaA__ABL67363

SEQ ID NO: 1482 - protein, 566 aa, Artificial Sequence
  hemagglutinin__InfluenzaA__ABL67374
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAHSNCYPYDVPDYASLRSLIASSGTLEFNNESFNWTGVTQNGTSSACKRRSNQSFFSRLNWLTHLKFKYPALNVTMPNNEKFDKLYIWGVHHPGTDSDQISLYAQAPGRITVSTKRSQQTVIPNIGSRPRVRDISSRISIYWTIVKPGDILLINSTGNLIAPRGYFKMRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGDGCFKIYHKCDNACIGSIRNGTYDHDVYRDEALNNRFQIKGVELKSGYKDWILWISFAISCLLLCVALLGFIMWACQKGNIRCNICI

SEQ ID NO: 1483 - protein, 566 aa, Artificial Sequence; identical to SEQ ID NO: 282
  hemagglutinin__InfluenzaA__ABL67385

SEQ ID NO: 1484 - protein, 566 aa, Artificial Sequence; identical to SEQ ID NO: 612
  hemagglutinin__InfluenzaA__ABL67396

SEQ ID NO: 1485 - protein, 566 aa, Artificial Sequence; identical to SEQ ID NO: 630
  hemagglutinin__InfluenzaA__ABL67407

SEQ ID NO: 1486 - protein, 566 aa, Artificial Sequence
  hemagglutinin__InfluenzaA__ABL67418
MKTIIALSYILCLVFAQKLPGNDNSTATLCLGHHAVPNGTIVKTITNDQIEVTNATELVQSSSTGGICNSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1487 - protein, 568 aa, Artificial Sequence; identical to SEQ ID NO: 28
  hemagglutinin__InfluenzaA__ABL67781

SEQ ID NO: 1488 - protein, 568 aa, Artificial Sequence
  hemagglutinin__InfluenzaA__ABL67794
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQREKRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 1489 - protein, 568 aa, Artificial Sequence
  hemagglutinin__InfluenzaA__ABL67816
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 1490 - protein, 568 aa, Artificial Sequence
  hemagglutinin__InfluenzaA__ABL67827
MEKIVLLFAIVSLVKSDHICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYEIVKKGDSTIMKSELEYGNCNTKCQTPMGAINSSMPFHNIHPLTIGECPKYVKSNRLVLATGLRNSPQIERRRKKRGLFGAIAGFLEGGWQGMVDGWYGYHHSNEQGSGYAADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 1491 - protein, 566 aa, Artificial Sequence
  hemagglutinin__InfluenzaA__ABM22015
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 1492 - protein, 566 aa, Artificial Sequence
  hemagglutinin__InfluenzaA__ABM22026
MKAKLLVLLCAFTATYADTICIGYHANNSTDTVDTVLEKNVTVTHSVNLLEDSHNGKLCRLKGTAPLQLGNCSIAGWILGNPECESLFSKESWSYIAETPNPKNGTCYPGYFADYEELREQLSSVSSFKRFEIFPKDSSWPNHTVTKGVTASCSHNGKSSFYKNLLWLTEKNGLYPNLSKSYVNKKGKEVLVLWGVHHPSNMGDQRAIYHKENAYVSVLSSHYSRRFTPEIARRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 1493 - protein, 566 aa, Artificial Sequence; identical to SEQ ID NO: 633
  hemagglutinin__InfluenzaA__ABM22037

SEQ ID NO: 1494 - protein, 566 aa, Artificial Sequence; identical to SEQ ID NO: 51
  hemagglutinin__InfluenzaA__ABM22059

SEQ ID NO: 1495 - protein, 566 aa, Artificial Sequence; identical to SEQ ID NO: 1305
  hemagglutinin__InfluenzaA__ABM22070

SEQ ID NO: 1496 - protein, 566 aa, Artificial Sequence
  hemagglutinin__InfluenzaA__ABM22081
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNIPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1497 - protein, 566 aa, Artificial Sequence
  hemagglutinin__InfluenzaA__ABM22092
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDHASLRSLVASSGTLEFNNESFDWAGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1498 - protein, 566 aa, Artificial Sequence; identical to SEQ ID NO: 1310
  hemagglutinin__InfluenzaA__ABM22103

SEQ ID NO: 1499 - protein, 566 aa, Artificial Sequence; identical to SEQ ID NO: 516
  hemagglutinin__InfluenzaA__ABM22114

SEQ ID NO: 1500 - protein, 566 aa, Artificial Sequence; identical to SEQ ID NO: 1455
  hemagglutinin__InfluenzaA__ABM22125

SEQ ID NO: 1501 - protein, 566 aa, Artificial Sequence
  hemagglutinin__InfluenzaA__ABM22136
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLAIGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1502 - protein, 566 aa, Artificial Sequence; identical to SEQ ID NO: 633
  hemagglutinin__InfluenzaA__ABM22147

SEQ ID NO: 1503 - protein, 566 aa, Artificial Sequence; identical to SEQ ID NO: 921
  hemagglutinin__InfluenzaA__ABM22158

SEQ ID NO: 1504 - protein, 566 aa, Artificial Sequence; identical to SEQ ID NO: 921
  hemagglutinin__InfluenzaA__ABM22169

SEQ ID NO: 1505 - protein, 566 aa, Artificial Sequence; identical to SEQ ID NO: 921
  hemagglutinin__InfluenzaA__ABM22180

SEQ ID NO: 1506 - protein, 566 aa, Artificial Sequence; identical to SEQ ID NO: 921
  hemagglutinin__InfluenzaA__ABM22191

SEQ ID NO: 1507 - protein, 566 aa, Artificial Sequence; identical to SEQ ID NO: 921
  hemagglutinin__InfluenzaA__ABM22202

SEQ ID NO: 1508 - protein, 566 aa, Artificial Sequence; identical to SEQ ID NO: 921
  hemagglutinin__InfluenzaA__ABM22213

SEQ ID NO: 1509 - protein, 566 aa, Artificial Sequence; identical to SEQ ID NO: 921
  hemagglutinin__InfluenzaA__ABM22224

SEQ ID NO: 1510 - protein, 566 aa, Artificial Sequence; identical to SEQ ID NO: 921
  hemagglutinin__InfluenzaA__ABM22235

SEQ ID NO: 1511 - protein, 566 aa, Artificial Sequence
  hemagglutinin__InfluenzaA__ABM22268
MKVKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1512 - protein, 566 aa, Artificial Sequence
  hemagglutinin__InfluenzaA__ABM22279
MKAKLLVLLCAFTATYADTICIGYHANNSTDTVDTVLEKNVTVTHSVNLLEDRHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGDCDAKCQTPQGAINSSLPFQNVHPVTIGGCPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDYHDSNVKNLYEKVKNQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 1513 - protein, 566 aa, Artificial Sequence
  hemagglutinin__InfluenzaA__ABM22290
MKAKLLVLLCAFTATYADTICIGYHANNSTDTVDTVLEKNVTVTHSVNLLENSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1514 - protein, 566 aa, Artificial Sequence; identical to SEQ ID NO: 255
  hemagglutinin__InfluenzaA__ABM22301

SEQ ID NO: 1515 - protein, 566 aa, Artificial Sequence; identical to SEQ ID NO: 255
  hemagglutinin__InfluenzaA__ABM22312

SEQ ID NO: 1516 - protein, 566 aa, Artificial Sequence; identical to SEQ ID NO: 255
  hemagglutinin__InfluenzaA__ABM22323

SEQ ID NO: 1517 - protein, 566 aa, Artificial Sequence; identical to SEQ ID NO: 255
  hemagglutinin__InfluenzaA__ABM22334

SEQ ID NO: 1518 - protein, 566 aa, Artificial Sequence; identical to SEQ ID NO: 256
  hemagglutinin__InfluenzaA__ABM22345

SEQ ID NO: 1519 - protein, 566 aa, Artificial Sequence; identical to SEQ ID NO: 256
  hemagglutinin__InfluenzaA__ABM22356

SEQ ID NO: 1520 - protein, 566 aa, Artificial Sequence; identical to SEQ ID NO: 256
  hemagglutinin__InfluenzaA__ABM22367

SEQ ID NO: 1521 - protein, 565 aa, Artificial Sequence; identical to SEQ ID NO: 841
  hemagglutinin__InfluenzaA__ABM66864

SEQ ID NO: 1522 - protein, 566 aa, Artificial Sequence; identical to SEQ ID NO: 921
  hemagglutinin__InfluenzaA__ABM66886

SEQ ID NO: 1523 - protein, 566 aa, Artificial Sequence; identical to SEQ ID NO: 921
  hemagglutinin__InfluenzaA__ABM66897

SEQ ID NO: 1524 - protein, 566 aa, Artificial Sequence; identical to SEQ ID NO: 921
  hemagglutinin__InfluenzaA__ABM66908

SEQ ID NO: 1525 - protein, 566 aa, Artificial Sequence; identical to SEQ ID NO: 256
  hemagglutinin__InfluenzaA__ABM66919

SEQ ID NO: 1526 - protein, 566 aa, Artificial Sequence; identical to SEQ ID NO: 256
  hemagglutinin__InfluenzaA__ABM66930

SEQ ID NO: 1527 - protein, 566 aa, Artificial Sequence; identical to SEQ ID NO: 256
  hemagglutinin__InfluenzaA__ABM66941

SEQ ID NO: 1528 - protein, 566 aa, Artificial Sequence; identical to SEQ ID NO: 256
  hemagglutinin__InfluenzaA__ABM66952

SEQ ID NO: 1529 - protein, 566 aa, Artificial Sequence; identical to SEQ ID NO: 256
  hemagglutinin__InfluenzaA__ABM66963

SEQ ID NO: 1530 - protein, 566 aa, Artificial Sequence; identical to SEQ ID NO: 256
  hemagglutinin__InfluenzaA__ABM66974

SEQ ID NO: 1531 - protein, 566 aa, Artificial Sequence; identical to SEQ ID NO: 256
  hemagglutinin__InfluenzaA__ABM66985

SEQ ID NO: 1532 - protein, 566 aa, Artificial Sequence; identical to SEQ ID NO: 256
  hemagglutinin__InfluenzaA__ABM66996

SEQ ID NO: 1533 - protein, 566 aa, Artificial Sequence; identical to SEQ ID NO: 256
  hemagglutinin__InfluenzaA__ABM67007

SEQ ID NO: 1534 - protein, 566 aa, Artificial Sequence; identical to SEQ ID NO: 256
  hemagglutinin__InfluenzaA__ABM67018

SEQ ID NO: 1535 - protein, 566 aa, Artificial Sequence
  hemagglutinin__InfluenzaA__ABM67029
MKTIIALSYIICLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRDIPSRISIYWTIVKPGDILLINSTGNLIAPRGYFRIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1536 - protein, 565 aa, Artificial Sequence; identical to SEQ ID NO: 299
  hemagglutinin__InfluenzaA__ABM67051

SEQ ID NO: 1537 - protein, 568 aa, Artificial Sequence
  hemagglutinin__InfluenzaA__ABM90467
MEKIVLLLSIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNNEAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1538 - protein, 568 aa, Artificial Sequence
  hemagglutinin__InfluenzaA__ABM90511
MEKIVLLLSIVSLVKSDQICIGYHANNSTEQVDTIIEKNVTVTHAQDILEKTHNGKLCDLDGVKPLILKDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNNEEEQTRLYQNPTTYISIGTSTLNQRLVPKIATRSKVNGQSGRMEFFWTILKPNDAINFESNGNFIAPEYAYKIVKKGDSAIMKSELEYSNCNTKCQTPMGAINSSMPFHNIHPLTIGECPKYVKSSRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1539 - protein, 568 aa, Artificial Sequence
  hemagglutinin__InfluenzaA__ABM90533
MEKIVLLLSIVSLVKSDQICIGYHANNSTEQVDTIMEKNVTVTHAQDILEKTHNGKLCDLDGVKPLILKDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNNEEEQTRLYQNPTTYISIGTSTLNQRLVPKIATRSKVNGQSGRMEFFWTILKPNDAINFESNGNFIAPEYAYKIVKKGDSAIMKSELEYSNCNTKCQTPMGAINSSMPFHNIHPLTIGECPKYVKSSRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 1540 - protein, 568 aa, Artificial Sequence; identical to SEQ ID NO: 1539
  hemagglutinin__InfluenzaA__ABM90544

SEQ ID NO: 1541 - protein, 566 aa, Artificial Sequence
  hemagglutinin__InfluenzaA__ABN50900
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHNVTRGVTASCSHKGKSSFYRNLLWLTEKNGSYPNLSKSYVNNKEKEVLVLWGVHHPSNIEDQKTIYRKENAYVSVVSSHYNRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1542 - protein, 566 aa, Artificial Sequence; identical to SEQ ID NO: 921
  hemagglutinin__InfluenzaA__ABN50917

SEQ ID NO: 1543 - protein, 566 aa, Artificial Sequence
  hemagglutinin__InfluenzaA__ABN50928
MKAKLLILLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTASCSHKGKSSFYRNLLWLTEKNGSYPNLSKSYVNNKEKEVLVLWGVHHPSNIGDQRAIYHTENAYVSVVSSHYNRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1544 - protein, 566 aa, Artificial Sequence
  hemagglutinin__InfluenzaA__ABN50940
MKAKLLVLLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFSDYEELREQLSSVSSFERFEIFPKESSWPNHTVTKGVTASCSHKGKSSFYRNLLWLTEKNGSYPNLSKSYVNNKEKEVLVLWGVHHPSNIGDQRAIYHTENAYVSVVSSHYNRRFTPEIAKRPKVRDQEGRINYYWTLLEPEDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1545 - protein, 566 aa, Artificial Sequence; identical to SEQ ID NO: 1511
  hemagglutinin__InfluenzaA__ABN50951

SEQ ID NO: 1546 - protein, 566 aa, Artificial Sequence
  hemagglutinin__InfluenzaA__ABN50962
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 1547 - protein, 566 aa, Artificial Sequence; identical to SEQ ID NO: 910
  hemagglutinin__InfluenzaA__ABN50973

SEQ ID NO: 1548 - protein, 566 aa, Artificial Sequence; identical to SEQ ID NO: 255
  hemagglutinin__InfluenzaA__ABN50984

SEQ ID NO: 1549 - protein, 566 aa, Artificial Sequence; identical to SEQ ID NO: 256
  hemagglutinin__InfluenzaA__ABN50995

SEQ ID NO: 1550 - protein, 566 aa, Artificial Sequence
  hemagglutinin__InfluenzaA__ABN51043
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1551 - protein, 566 aa, Artificial Sequence; identical to SEQ ID NO: 1396
  hemagglutinin__InfluenzaA__ABN51054

SEQ ID NO: 1552 - protein, 566 aa, Artificial Sequence
  hemagglutinin__InfluenzaA__ABN51066
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKKSSWPNHTVTKGVTASCSHNGKSSFYKNLLWLTEKNGLYPNLSKSYVNNKEKEVLVLWGVHHPSNIGDQRTIYHTENAYVSVVSSHYSRRFTPEIAKRPKVRDQEGRINYYWTLLEPGDTIIFEANGNLIAPWYAFALSRGFGSGIITSNASMGDCDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECIESVKNGTYDYPKYSEESKLKREKIDGVKLESMGVYQILAIYSTVASSLVLLVSLGAIGFWMCSNGSLQCRICI

SEQ ID NO: 1553 - protein, 565 aa, Artificial Sequence; identical to SEQ ID NO: 296
  hemagglutinin__InfluenzaA__ABN51077

SEQ ID NO: 1554 - protein, 565 aa, Artificial Sequence; identical to SEQ ID NO: 299
  hemagglutinin__InfluenzaA__ABN51088

SEQ ID NO: 1555 - protein, 566 aa, Artificial Sequence
  hemagglutinin__InfluenzaA__ABN51099
MKTIIALSYIFCLALGQDLPGNDNSTATLCLGHHAVPNGTLVKTITNDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKMNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1556 - protein, 566 aa, Artificial Sequence
  hemagglutinin__InfluenzaA__ABN51110
MKTIIALSYIFCLALGQDLPGNDNSTATLCLGHHAVPNGTLVKTITDDQIEVTNATELVQSSSTGKICNNPHRILDGINCTLIDALLGDPHCDVFQDETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1557 - protein, 566 aa, Artificial Sequence
  hemagglutinin__InfluenzaA__ABN51121
MKTIIALSYIFCLALGQDLPGNDNSTATLCLGHHAVPNGTLVKTITDDQIEVTNATELVQSSSTGKICNNPHRILDGINCTLIDALLGDPHCDVFQDETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGTCPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDLEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1558 - protein, 566 aa, Artificial Sequence
  hemagglutinin__InfluenzaA__ABN51132
MKTIIALSYIFCLALGQDLPGNDNSTATLCLGHHAVPNGTLVKTITDDQIEVTNATELVQSSSTGKICNNPHRILDGINCTLIDALLGDPHCDVFQDETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDASIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1559 - protein, 565 aa, Artificial Sequence; identical to SEQ ID NO: 800
  hemagglutinin__InfluenzaA__ABN51143

SEQ ID NO: 1560 - protein, 566 aa, Artificial Sequence
  hemagglutinin__InfluenzaA__ABN51154
MKTIIALSYILCLVFTQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1561 - protein, 566 aa, Artificial Sequence
  hemagglutinin__InfluenzaA__ABN59390
MKTIIALSYIICLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFRIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1562 - protein, 566 aa, Artificial Sequence
  hemagglutinin__InfluenzaA__ABN59401
MKAKLLVLLCALSATDADTICIGYHANNSTDTVDTVLEKNVTVTHSVNLLEDSHNGKLCRLKGIAPLQLGKCNIAGWILGNPECESLFSKKSWSYIAETPNSENGTCYPGYFADYEELREQLSSVSSFERFEIFPKERSWPKHNITRGVTAACSHKGKSSFYRNLLWLTEKNGSYPNLNKSYVNNKEKEVLVLWGVHHPSNIEDQKTLYRKENAYVSVVSSNYNRRFTPEIAERPKVRGQAGRINYYWTLLEPGDTIIFEANGNLIAPWHAFALSRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1563 - protein, 565 aa, Artificial Sequence
  hemagglutinin__InfluenzaA__ABN59412
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLEFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 1564 - protein, 566 aa, Artificial Sequence
  hemagglutinin__InfluenzaA__ABN59423
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIENQKTIYRKENAYVSVVSSNYNRRFTPEIAERPKVRDQEGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1565 - protein, 566 aa, Artificial Sequence; identical to SEQ ID NO: 766
  hemagglutinin__InfluenzaA__ABO32656

SEQ ID NO: 1566 - protein, 566 aa, Artificial Sequence
  hemagglutinin__InfluenzaA__ABO32667
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1567 - protein, 565 aa, Artificial Sequence
  hemagglutinin__InfluenzaA__ABO32678
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLHKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1568 - protein, 566 aa, Artificial Sequence
  hemagglutinin__InfluenzaA__ABO32692
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1569 - protein, 566 aa, Artificial Sequence; identical to SEQ ID NO: 1433
  hemagglutinin__InfluenzaA__ABO32751

SEQ ID NO: 1570 - protein, 566 aa, Artificial Sequence; identical to SEQ ID NO: 1433
  hemagglutinin__InfluenzaA__ABO32762

SEQ ID NO: 1571 - protein, 566 aa, Artificial Sequence; identical to SEQ ID NO: 1455
  hemagglutinin__InfluenzaA__ABO32775

SEQ ID NO: 1572 - protein, 566 aa, Artificial Sequence; identical to SEQ ID NO: 243
  hemagglutinin__InfluenzaA__ABO32790

SEQ ID NO: 1573 - protein, 566 aa, Artificial Sequence
  hemagglutinin__InfluenzaA__ABO32803
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYVSLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDTLLINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1574 - protein, 566 aa, Artificial Sequence; identical to SEQ ID NO: 633
  hemagglutinin__InfluenzaA__ABO32816

SEQ ID NO: 1575 - protein, 566 aa, Artificial Sequence; identical to SEQ ID NO: 256
  hemagglutinin__InfluenzaA__ABO32827

SEQ ID NO: 1576 - protein, 566 aa, Artificial Sequence
  hemagglutinin__InfluenzaA__ABO32838
MKTIIALSYILCLVFAQKLPGNDNSTATLCLGHHAVPNGTIVKTITNDQIEVTNATELVQSSSTGGICDSPHQILDGENCTLIDALLGDPQCDGFQNKRWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1577 - protein, 566 aa, Artificial Sequence; identical to SEQ ID NO: 1576
  hemagglutinin__InfluenzaA__ABO32849

SEQ ID NO: 1578 - protein, 566 aa, Artificial Sequence
  hemagglutinin__InfluenzaA__ABO32860
MKTIIALSYILCLVFAQKLPGNDNSTATLCLGHHAVPNGTIVKTITNDQIEVTNATELVQSSSTGGICDSPHQILDGENCTLIDALLGDPQCDGFQNKRWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1579 - protein, 566 aa, Artificial Sequence; identical to SEQ ID NO: 1561
  hemagglutinin__InfluenzaA__ABO32871

SEQ ID NO: 1580 - protein, 566 aa, Artificial Sequence
  hemagglutinin__InfluenzaA__ABO32882
MKTIIALSYIICLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFRIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1581 - protein, 566 aa, Artificial Sequence
  hemagglutinin__InfluenzaA__ABO32893
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1582 - protein, 566 aa, Artificial Sequence; identical to SEQ ID NO: 1581
  hemagglutinin__InfluenzaA__ABO32904

SEQ ID NO: 1583 - protein, 566 aa, Artificial Sequence; identical to SEQ ID NO: 1396
  hemagglutinin__InfluenzaA__ABO32915

SEQ ID NO: 1584 - protein, 566 aa, Artificial Sequence; identical to SEQ ID NO: 1396
  hemagglutinin__InfluenzaA__ABO32926

SEQ ID NO: 1585 - protein, 566 aa, Artificial Sequence
  hemagglutinin__InfluenzaA__ABO32937
MKTIIALSYILCLVFAQKLPGNDNSTATLCLGHHAVPNGTIVRTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSSCKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1586 - protein, 565 aa, Artificial Sequence
  hemagglutinin__InfluenzaA__ABO32948
MRAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1587 - protein, 565 aa, Artificial Sequence
  hemagglutinin__InfluenzaA__ABO32959
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSRSYVNNKEKEVLVLWGVHHPPNIGDQRALYHTENAYVSVVSSHYSRRFTPEIAKRPKVRDQEGRINYYWTLLEPGDTLIFEANGNLIAPWYAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1588 - protein, 565 aa, Artificial Sequence; identical to SEQ ID NO: 1204
  hemagglutinin__InfluenzaA__ABO32970

SEQ ID NO: 1589 - protein, 566 aa, Artificial Sequence
  hemagglutinin__InfluenzaA__ABO32981
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIKDQKTIYRKENAYVSVVSSNYNRRFTPEIAERPKVRDQAGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1590 - protein, 566 aa, Artificial Sequence
  hemagglutinin__InfluenzaA__ABO32992
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHDVTRGVTASCSHKGKSSFYRNLLWLTEKNGSYPNLSKSYVNNKEKEVLVLWGVHHPSNIEDQKTIYRKENAYVSVVSSNYNRRFTPEISERPKVRDQKGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1591 - protein, 566 aa, Artificial Sequence
  hemagglutinin__InfluenzaA__ABO33006
MKAKILVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEISKRPKVRDQEGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1592 - protein, 566 aa, Artificial Sequence
  hemagglutinin__InfluenzaA__ABO33025
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPNHNVTKGVTASCSHKGKSSFYRNLLWLTEKNGSYPNLSKSYVNNKEKEVLVLWGVHHPSNIKDQRTIYRKENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQSAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1593 - protein, 566 aa, Artificial Sequence
  hemagglutinin__InfluenzaA__ABO33036
MKTIIALSYILCLVFAQKLPGNDNSTATLCLGHHAVPNGTLVKTITNDQIEVTNATELVQSSSTGRICNSPHQILDGENCTLIDALLGDPHCDGFQNKEWDLFVERRKAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1594 - protein, 566 aa, Artificial Sequence; identical to SEQ ID NO: 72
  hemagglutinin__InfluenzaA__ABO33047

SEQ ID NO: 1595 - protein, 566 aa, Artificial Sequence; identical to SEQ ID NO: 650
  hemagglutinin__InfluenzaA__ABO33058

SEQ ID NO: 1596 - protein, 566 aa, Artificial Sequence
  hemagglutinin__InfluenzaA__ABO33069
MKTIIALSYIFCLVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQNGGSYACKRGPDNSFFSRLNWLYESESKYPVLNVTMPNNDNFDKLYIWGVHHPSTDKEQTNLYVQASGRVTVSTKKSQQTIIPNVGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYIEDTKIDLWSYNAELLVALENQHTIDLTDSKMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1597 - protein, 566 aa, Artificial Sequence; identical to SEQ ID NO: 921
  hemagglutinin__InfluenzaA__ABO37988

SEQ ID NO: 1598 - protein, 566 aa, Artificial Sequence
  hemagglutinin__InfluenzaA__ABO38010
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGVGSGIITSNASMGDCDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 1599 - protein, 565 aa, Artificial Sequence
  hemagglutinin__InfluenzaA__ABO38021
MKAKLLVLLCTFTATYADTICIGYHANNSTDTVDTVLEKNVTVTHSVNLLEDSHNGKLCLLKGIAPLQLGNCSVAGWILGNPECELLIPKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFIPEMAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1600 - protein, 565 aa, Artificial Sequence
  hemagglutinin__InfluenzaA__ABO38032
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPDPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPKGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGIYQILAIYSTVASSLVLLVSLGAISFWMCSNGSLQCRICI

SEQ ID NO: 1601 - protein, 565 aa, Artificial Sequence; identical to SEQ ID NO: 800
  hemagglutinin__InfluenzaA__ABO38043

SEQ ID NO: 1602 - protein, 566 aa, Artificial Sequence
  hemagglutinin__InfluenzaA__ABO38054
MKARLLVLLCALAATDADTICIGYHANNSTDTVDTVLEKNVTVTHSVNLLEDSHNGKLCRLKGIAPLQLGKCNIAGWILGNPECESLLSERSWSYIVETPNSENGTCYPGDFIDYEELREQLSSVSSFERFEIFSKESSWPKHNTTRGVTAACSHAGKSSFYRNLLWLTEKDGSYPNLNNSYVNKKGKEVLVLWGVHHPSNIKDQQTLYQKENAYVSVVSSNYNRRFTPEIAERPKVRGQAGRMNYYWTLLKPGDTIMFEANGNLIAPWYAFALSRGFGSGIITSNASMHECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1603 - protein, 566 aa, Artificial Sequence
  hemagglutinin__InfluenzaA__ABO38065
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNITRGVTASCSHKGKSSFYRNLLWLTEKNGSYPNLSKSYVNNKEKEVLVLWGVHHPSNIEDQKTIYRKENAYVSVVSSNYNRRFTPEIAKRPKVRGQEGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1604 - protein, 566 aa, Artificial Sequence; identical to SEQ ID NO: 243
  hemagglutinin__InfluenzaA__ABO38076

SEQ ID NO: 1605 - protein, 566 aa, Artificial Sequence
  hemagglutinin__InfluenzaA__ABO38087
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDVGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1606 - protein, 562 aa, Artificial Sequence
  hemagglutinin__InfluenzaA__ABO38098
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGQGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 1607 - protein, 566 aa, Artificial Sequence
  hemagglutinin__InfluenzaA__ABO38230
MKTIIALSYIFCQVFAQNLPGNDNSTATLCLGHHAVPNGTLVKTITNDQIEVTNATELVQSSSTGRICDNPHRILDGKNCTLIDALLGDPHCDGFQNEKWDLFVERSKAFSNCYPYDVPDYASLRSLVASSGTLEFFNEGFNWTGVTQNGGSYACKRGPDNSFFSRLNWLYKSESTYPVLNVTMPNNDNFDKLYIWGVHHPSTDKEQTNLYVQASGRVTVSTKRSQQTIIPSVGSRPWVRGLSSRISIYWTIVKPGDVLLINSNGNLIAPRGYFKIRTGKSSIMRSDAPIGTCSSECITPNGSIPNDKPFQNVDKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1608 - protein, 566 aa, Artificial Sequence
  hemagglutinin__InfluenzaA__ABO38241
MKTIIALSYISCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYTCKRGSVNSFFSRLNWLYESESKYPALNVTMPNNGKFDKLYIWGVHHPSTDKEQTNLYVRASGRVTVSTKRSQQTVIPNIGPRPWVRGLSSRISIYWTIVKPGDILLINSTGNLIAPRGYFKIRTGKSSIMRSDAPIGTCSSGCITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDMTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1609 - protein, 566 aa, Artificial Sequence; identical to SEQ ID NO: 282
  hemagglutinin__InfluenzaA__ABO38252

SEQ ID NO: 1610 - protein, 562 aa, Artificial Sequence
  hemagglutinin__InfluenzaA__ABO38296
MVIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHFLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNAKELGNGCFEFYHKCDDECMNSVKNGTYYYPKYEEESKLNRNEIKGVKLSSMGVYQILAIYATVAGSLSLAIMMAGISFWMCSNGSLQCRICI

SEQ ID NO: 1611 - protein, 565 aa, Artificial Sequence; identical to SEQ ID NO: 870
  hemagglutinin__InfluenzaA__ABO38318

SEQ ID NO: 1612 - protein, 565 aa, Artificial Sequence; identical to SEQ ID NO: 800
  hemagglutinin__InfluenzaA__ABO38329

SEQ ID NO: 1613 - protein, 566 aa, Artificial Sequence
  hemagglutinin__InfluenzaA__ABO38351
MKARLLVLLCALAATDADTICIGYHANNSTDTVDTVLEKNVTVTHSVNLLEDSHNGKLCRLKGIAPLQLGKCNIAGWLLGNPECDPLLPARSWSYIVETPNSENGICYPGAFIDYEELREQLSSVSSFERFEIFPKESSWPNHNTNIGVTAACSHAGKSSFYRNLLWLTKKGGSYPKLKNSYVNKKGKEVLVLWGIHHPSNSKDQQTLYQNENAYVSVVSSNYNRRFTPEIAERPEVRDQAGRMNYYWTLLEPGDTIMFEANGNLVAPWYAFALSRGFGSGIITSNASMHECNTKCQTPQGAINSSLPFQNIHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKIDGVKLESMGVYQILAIYSTVASSLVLLVSLGAISFWMCSNGSLQCRICI

SEQ ID NO: 1614 - protein, 566 aa, Artificial Sequence
  hemagglutinin__InfluenzaA__ABO38362
MKAKLLVLLCALSATDADTICIGYHANNSTDTVDTVLEKNVTVTHSVNLLEDSHNGKLCRLKGIAPLQLGKCSIAGWILGNPECESLVSKKSWSYIAETPNSENGTCYPGYFADYEELREQLSSVSSFERFEIFPKESSWPKHNVTRGVTASCSHKGKSSFYRNLLWLTEKNGSYPNLSKSYVNNKEKEVLVLWGVHHPSNIENQKTIYRKENAYVSVVSSHYNRRFTPEIAKRPKVRDQEGRINYYWTLLEPGDTIIFEANGNLIAPWYAFALSRGFGSGIITSNASIDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1615 - protein, 565 aa, Artificial Sequence
  hemagglutinin__InfluenzaA__ABO38373
MKARLLVLLCALAATDADTICIGYHANNSTDTVDTVLEKNVTVTHSVNLLEDSHNGKLCRLKGIAPLQLGKCNIAGWILGNPECESLLSERSWSYIVETPNSENGTCYPGDFIDYEELREQLSSVSSFERFEIFSKESSWPKHTTGGVTAACSHAGKSSFYRNLLWLTEKDGSYPNLNNSYVNKKGKEVLVLWGVHHPSNIKDQQTLYQKENAYVSVVSSNYNRRFTPEIAERPKVRGQAGRINYYWTLLKPGDTIMFEANGNLIAPWYAFALSRGFGSGIITSNASMHECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTAASSLVLLVSLGAISFWMCSNGSLQCRICI

SEQ ID NO: 1616 - protein, 566 aa, Artificial Sequence
  hemagglutinin__InfluenzaA__ABO38384
MKARLLVLLCALAAADADTICIGYHANNSTDTVDTVLEKNVTVTHSVNLLEDSHNGKLCRLKGIPPLQLGKCNIAGWLLGNPECDSLLPARSWSYIVETPNSENGACYPGDFINYEELREQLSSVSSFERFEIFPKESSWPKHNTTKGVTAACSHAGKSSFYRNLLWLTKKEDSYPKLKNSYVNKKGKEVLVLWGVHHPSSSKEQQTLYQNENAYVSVVSSNYNRRFTPEIAERPKVRDQTGRMNYYWTLLEPGDTIIFEANGNLIAPWYAFALSRGFGSGIITSNASMHECNTKCQTPQGAINSSLPFQNIHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKIDGVKLESMGVYQILAIYSTVASSLVLLVSLGAISFWMCSNGSLQCRICI

SEQ ID NO: 1617 - protein, 566 aa, Artificial Sequence
  hemagglutinin__InfluenzaA__ABO38395
MKAKLLVLLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTASCSHKGRSSFYRNLLWLTKKNGSYPNLSKSYVNNKEKEVLVLWGVHHPSNIGDQRAIYHTENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1618 - protein, 566 aa, Artificial Sequence
  hemagglutinin__InfluenzaA__ABO38406
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPNHNVTKGVTASCSHKGKSSFYRNLLWLTEKKGSYPNLSKSYVNNKEKEVLVLWGIHHPSNIEDQKTIYRKENAYVSVVSSHYNRRFTPEIAKRPKVRDQEGRINYYWTLLEPGDTIIFEANGNLIAPWYAFALSRGFGSGIITSNASMDECDAKCQTPRGAINSSLPFQNVHPVTIGECPKYVRSTKLRMVTGLRNIPSIQSRGLFGAIAGFIEGGWTGMIDGWYGYHHQNEQGSGYAADQKSTQSAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1619 - protein, 566 aa, Artificial Sequence
  hemagglutinin__InfluenzaA__ABO38417
MKTIIALSYILCLVFAQKLPVNDNSTATLCLGHHAVPNGTLVKTITNDHIEVTNATELVQSSPTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNTPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1620 - protein, 562 aa, Artificial Sequence
  hemagglutinin__InfluenzaA__ABO38712
MAIIYFILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVRILPKDGWTQHTTSGGSKACAVSGKSSFFRNMVWLTKKGPNYPVAKRSYNNTSGEQMLIIWGVHHPKDEAEQRALYQKVGTYVSASTSTLNKRSTPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNTQFEAVGKEFSNLEKRLENLNKKMEDGFLDVWTYNAELLVLMENERTLDFHDSNVKNLYNKVRMQLRDNVKELGNGCFEFYHKCDDECMSSVKNGTYDYPKYEEESKLKRNEIKGVKLSSMGVYQILAIYATVAGSLSLAIMIAGISLWMCSNGSLQCRICI

SEQ ID NO: 1621 - protein, 562 aa, Artificial Sequence
  hemagglutinin__InfluenzaA__ABO38723
MAIIYFILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVRILPKDGWTQHTTSGGSKACAVSGKSSFFRNMVWLTKKGPNYPVAKRSYNNTSGEQMLIIWGVHHPNDEAEQRALYQKVGTYVSASTSTLNKRSTPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNTQFEAVGKEFSNLEKRLGNLNKKMEDGFLDVWTYNAELLVLMENERTLDFHDSNVKNLYNKVRMQLRDNVKELGNGCFEFYHKCDDECMSSVKNGTYDYPKYEEESKLKRNEIKGVKLSSMGVYQILAIYATVAGSLSLAIMIAGISLWMCSNGSLQCRICI

SEQ ID NO: 1622 - protein, 565 aa, Artificial Sequence
  hemagglutinin__InfluenzaA__ABO44046
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKMNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1623 - protein, 562 aa, Artificial Sequence
  hemagglutinin__InfluenzaA__ABO44057
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDGWTQHETDGGSKACAVSGKASFFRNMVWLTKRGPNYQVAKRSYNNTSGEQMLIIWGVHHPKDEAEQRALYQKVGTYVSASTSTLNKRSTPEIAARPEVNGLESRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNIQFEAVGKEFSNLEKRLENLNKKMEDGFLDVWTYNAELLVLMENERTLDFHDSNVKNLYDKVRMQLRDNVKELGNGCFEFYHKCDDECMNSVKNGTYDYPKYEEESKLKRNEIKGVKLSSMGVYQILAIYATVAGSLSLAIMIAGISFWMCSNGSLQCRVCI

SEQ ID NO: 1624 - protein, 566 aa, Artificial Sequence; identical to SEQ ID NO: 256
  hemagglutinin__InfluenzaA__ABO44079

SEQ ID NO: 1625 - protein, 562 aa, Artificial Sequence
  hemagglutinin__InfluenzaA__ABO44090
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRDGLCYPGSFNDYEELKHLLSSVKHFEKVKILPKDRWTQHTTTGGSRACAVSGNPSFFRNMIWLTKKGSNYPVAKGSYNNTSGEQMLIIWGVHHPNDETEQRTLYQNVGTYVSVVTSTLNKRSTPKIATRPKVNGLGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQRAFDGITNKVNSVIEKMNTQFEAVGKEFSNLERRLENLNKKMEDGLLDVWTYNAELLVLMENERILDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 1626 - protein, 562 aa, Artificial Sequence
  hemagglutinin__InfluenzaA__ABO44101
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDGWTQHKTDGGSKACAVSGKPSFFRNMVWLTKKGPNYPVAKRSYNNTSGEQMLIIWGVHHPNDEAEQRALYQKVGTYVSASTSTLNKRSTPEIAARPEVSGLGSRMEFSWTLLDVWDTISFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDDECMNSVKNGTYDYPKYEEESKLKRNEIKGVKLSSMGVYQILAIYATVAGSLSLAIMIAGISFWMCSNGSLQCRICI

SEQ ID NO: 1627 - protein, 566 aa, Artificial Sequence
  hemagglutinin__InfluenzaA__ABO44123
MKAKLLVLLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTASCSHKGKSSFYRNLLWLTKKNGSYPNLSKSYVNNKEKEVLVLWGVHHPSNIGDQRAIYHTENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1628 - protein, 566 aa, Artificial Sequence
  hemagglutinin__InfluenzaA__ABO44134
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAERPKVRGQAGRINYYWTLLEPGDTIIFEANGNLIAPWHAFALSRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1629 - protein, 566 aa, Artificial Sequence
  hemagglutinin__InfluenzaA__ABO52071
MKTIIALSYILCLVFAQKLPGNDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPSTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1630 - protein, 566 aa, Artificial Sequence
  hemagglutinin__InfluenzaA__ABO52225
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELKEQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNDECMESVKNGTYDYPKYSEESKLKREKIDGVKLESMGVYQILAIYSTVASSLVLLVSLGAISFWMCSNGSLQCRICI

SEQ ID NO: 1631 - protein, 562 aa, Artificial Sequence
  hemagglutinin__InfluenzaA__ABO52236
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHFLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNAKELGNGCFEFYHKCDDECMNSVKNGTYYYPKYEEESKLNRNEIKGVKLSSMGVYQILAIYATVAGSLSLAIMMAGISFWMCSNGSLQCRICI

SEQ ID NO: 1632 - protein, 562 aa, Artificial Sequence
  hemagglutinin__InfluenzaA__ABO52247
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDGWTQHKTDGGSKACAVSGKPSFFRNMVWLTKKGPNYPVAKRSYNNTSGEQMLIIWGVHHPNDEAEQRALYQKVGTYVSASTSTLNKRSTPEIAARPEVSGLGSRMEFSWTLLDVWDTISFESTGNLVAPEYGFKISKRGSSGIMKTEGTLGNCETKCQTPLGAINTTLPFHNVHPLTIGECPKYVKSEKLVLATGPRNVPQIESRGLFGAIAGFIEGGWQGMVDGWYGYHHSNDQGSGYAADKESTQKAFDRITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDDECMNSVKNGTYDYPKYEEESKLKRNEIKGVKLSSMGVYQILAIYATVAGSLSLAIMIAGISFWMCSNGSLQCRICI

SEQ ID NO: 1633 - protein, 566 aa, Artificial Sequence
  hemagglutinin__InfluenzaA__ABO52258
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHNVTRGVTASCSHKGKCSFYRNLLWLTEKNGSYPNLSKSYVNNKEKEVLVLWGVHHPSNIEDQKTIYRKENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1634 - protein, 566 aa, Artificial Sequence
  hemagglutinin__InfluenzaA__ABO52280
MKARLLILLCALSATDADTICIGYHANNSTDTVDTVLEKNVTVTHSVNLLEDSHNGKLCRLKGIAPLQLGKCNIAGWILGNPECESLLSNRSWSYIAETPNSENGICYPGDFADYEELREQLSSVSSFERFEIFPKESSWPKHNITRGVTVACSHAKKSSFYKNLLWLTEANGLYPSLSKSYVNDREKEVLVLWGVHHPSNIEDQRTLYRKENAYVSVVSSNYNRRFTPEIAERPKVRGQPGRMNYYWTLLEPGDKIIFEANGNLIAPWYAFALSRGPGSGIITSNASMDECDTKCQTPQGAINSSLPFQNIHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCDNECMESVKNGTYDYPKYSEESKLNRAKIDGVKLESMGVYQILAIYSTVASSLVLLVSLGAISFWMCSNGSLQCRICI

SEQ ID NO: 1635 - protein, 562 aa, Artificial Sequence
  hemagglutinin__InfluenzaA__ABO52302
MAIIYLILLFTAVRGDQICIGYHANNSTEKVDTILERNVTVTHAKDILEKTHNGKLCKLNGIPPLELGNCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGIYQILAIYATVAGSLSLAIMMAGISFWMCSNGSLQCRICI

SEQ ID NO: 1636 - protein, 566 aa, Artificial Sequence
  hemagglutinin__InfluenzaA__ABO52313
MKTIIALSYIFCLVFAQNLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDSGFFSRLNWLYKSGSTYPVLNVTMPNNDNFDKLYIWGVHHPSTDQEQTNLYVQASGRVTVSTKRSQQTIIPNVGSRPWVRGLSSRISIYWTIVKPGDILVINSNGNLIAPRGHFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHRNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1637 - protein, 566 aa, Artificial Sequence
  hemagglutinin__InfluenzaA__ABO52335
MKTIIALSYIFCLVLGQDFPRNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDSGFFSRLNWLYKSGNTYPVLNVTMPNNDNFDKLYIWGVHHPSTDQDQTSLYVQASGRVTVSTKRSQQTVIPNIGPRPWVRGLSSRISIYWTIVKPGDILLINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHRCDNACIGSIRNGTYDHDVYRDEALNNRFQIKGVELKSGYKDWILWISFAISCFLLCVVLLGFIMWACQKGNIRCNICI

SEQ ID NO: 1638 - protein, 566 aa, Artificial Sequence
  hemagglutinin__InfluenzaA__ABO52346
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSDCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1639 - protein, 566 aa, Artificial Sequence
  hemagglutinin__InfluenzaA__ABO52357
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCIFECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1640 - protein, 566 aa, Artificial Sequence
  hemagglutinin__InfluenzaA__ABO52368
MKTIIALSYIFCLALGQDLPGNDNSTATLCLGHHAVPNGTLVKTITNDQIEVTNATELVQSSSTGKICNNPHRILDGINCTLIDALLGDPHCDVFQDETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1641 - protein, 566 aa, Artificial Sequence
  hemagglutinin__InfluenzaA__ABO52797
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPNHNVTKGVTASCSHKGKSSFYRNLLWLTEKNGSYPSLSKSYVNNKEKEVLVLWGVHHPSNIKDQKTIYRKENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQSAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1642 - protein, 565 aa, Artificial Sequence; identical to SEQ ID NO: 742
  hemagglutinin__InfluenzaA__ABP49217

SEQ ID NO: 1643 - protein, 565 aa, Artificial Sequence
  hemagglutinin__InfluenzaA__ABP49305
MKAKLMVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1644 - protein, 566 aa, Artificial Sequence
  hemagglutinin__InfluenzaA__ABP49316
MKAKLLVLLCALSATDADTICIGYHANNSTDTVDTVLEKNVTVTHSVNLLEDSHNGKLCRLKGIAPLQLGKCNIAGWILGNPECESLFSKKSWSYIAETPNSENGTCYPGYFADYEELREQLSSVSSFERFEIFPKERSWPKHNITRGVTAACSHKGKSSFYRNLLWLTEKNGSYPNLKKSYVNNKEKEVLVLWGVHHPSNIEDQKTLYRKENAYVSVVSSNYNKRFTPEIAERPKVRGQAGRINYYWTLLEPGDTIIFEANGNLIAPWHAFALSRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1645 - protein, 566 aa, Artificial Sequence
  hemagglutinin__InfluenzaA__ABP49327
MKARLLVLLCALAATDADTICIGYHANNSTDTVDTVLEKNVTVTHSVNLLEDSHNGKLCRLKGIAPLQLRKCNIAGWILGNPECESLLSERSWSYIVETPNSENGTCYPGDFTNYEELREQLSSVSSFERFEIFPKESSWPKHNTTRGVTAACSHAGKSSFYRNLLWLTEKDGSYPNLNNSYVNKKGKEVLVLWGVHHPSNIKDQQTLYQKENAYVSVVSSNYNRRFTPEIAERPKVRGQAGRMNYYWTLLKPGDTIMFEANGNLIAPWYAFALSRGFGSGIITSNASMHECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLILLENERTLDFHDSNVKNLYEKVKSQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1646 - protein, 566 aa, Artificial Sequence
  hemagglutinin__InfluenzaA__ABP49338
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAKRPKVRGQEGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1647 - protein, 566 aa, Artificial Sequence
  hemagglutinin__InfluenzaA__ABP49349
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPNHNVTKGVTASCSHKGKSSFYRNLLWLTEKNGSYPNLSKSYVNNKEKEVLVLWGIHHPSNIEDQKTIYRKENAYVSVVSSHYNRRFTPEIAKRPKVRDQEGRINYYWTLLEPGDTIIFEANGNLIAPWYAFALSRGFGSGIITSNASMDECDAKCQTPLGAINSSLPFQNVHPVTIGECPKYVRSTKLRMVTGLRNIPSIQSRGLFGAIAGFIEGGWTGMIDGWYGYHHQNEQGSGYAADQKSTQSAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1648 - protein, 566 aa, Artificial Sequence
  hemagglutinin__InfluenzaA__ABP49360
MKAKLLILLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTASCSHNGKSSFYRNLLWLTKKNGSYPNLSKSYVNNKEKEVLVLWGVHHPSNIGDQRAIYHTENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1649 - protein, 566 aa, Artificial Sequence; identical to SEQ ID NO: 650
  hemagglutinin__InfluenzaA__ABP49371

SEQ ID NO: 1650 - protein, 566 aa, Artificial Sequence; identical to SEQ ID NO: 1387
  hemagglutinin__InfluenzaA__ABP49382

SEQ ID NO: 1651 - protein, 565 aa, Artificial Sequence
  hemagglutinin__InfluenzaA__ABP49393
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGIHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNRERIDGVKLESMGVYQILAIYSTVASSLVLLVSLGAISFWMCSNGSLQCRICI

SEQ ID NO: 1652 - protein, 566 aa, Artificial Sequence
  hemagglutinin__InfluenzaA__ABP49404
MKTIIALSYTLCLVFAQKLPGNDNSTATLCLGHHAVPNGTIVKTITNDQIEVTNATELVQSSSTGGICDSPHQILDGENCTLIGALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1653 - protein, 566 aa, Artificial Sequence; identical to SEQ ID NO: 650
  hemagglutinin__InfluenzaA__ABP49415

SEQ ID NO: 1654 - protein, 566 aa, Artificial Sequence; identical to SEQ ID NO: 650
  hemagglutinin__InfluenzaA__ABP49426

SEQ ID NO: 1655 - protein, 562 aa, Artificial Sequence
  hemagglutinin__InfluenzaA__ABP49437
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPEIATRPKVNGLGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 1656 - protein, 566 aa, Artificial Sequence
  hemagglutinin__InfluenzaA__ABP49448
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEISERPKVRGQEGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1657 - protein, 562 aa, Artificial Sequence
  hemagglutinin__InfluenzaA__ABP49459
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTPTLNKRSTPDIATRPKVNGQGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 1658 - protein, 562 aa, Artificial Sequence
  hemagglutinin__InfluenzaA__ABP49470
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVSTSTLNKRSTPDIATRPKVNGLGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 1659 - protein, 566 aa, Artificial Sequence
  hemagglutinin__InfluenzaA__ABP49492
MKTIIALSYIFCLVFAQGLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSSCKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1660 - protein, 566 aa, Artificial Sequence; identical to SEQ ID NO: 1556
  hemagglutinin__InfluenzaA__ABP49503

SEQ ID NO: 1661 - protein, 566 aa, Artificial Sequence
  hemagglutinin__InfluenzaA__ABP49514
MKTIIALSYIFYLALGQDLPGNDNSTATLCLGHHAVPNGTLVKTITNDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1662 - protein, 566 aa, Artificial Sequence
  hemagglutinin__InfluenzaA__ABQ01311
MKARLLILLCALSATDADTICIGYHANNSTDTVDTVLEKNVTVTHSVNLLEDSHNGKLCRLKGIAPLQLGKCNIAGWILGNPECESLLSNRSWSYIAETPNSENGTCYPGDFADYEELREQLSSVSSFERFEIFPKERSWPKHNITRGVTAACSHAKKSSFYKNLLWLTEANGSYPNLSKSYVNNKEKEVLVLWGVHHPSKIEDQRTLYRKENAYVSVVSSNYNRRFTPEIAERPKVRGQAGRMNYYWTLLEPGDKIIFEANGNLIAPWYAFALSRGLGSGIITSNASMDECDTKCQTPQGAINSSLPFQNIHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCDNECMESVKNGTYDYPKYSEESKLNREKIDGVKLESMGVYQILAIYSTVASSLVLLVSLGAISFWMCSNGSLQCRICI

SEQ ID NO: 1663 - protein, 566 aa, Artificial Sequence
  hemagglutinin__InfluenzaA__ABQ01322
MKAKLLVLLCALSATDADTICIGYHANNSTDTVDTVLEKNVTVTHSVNLLEDSHNGKLCRLKGIAPLHLGKCSIAGWILGNPECESLFSKKSWSYIAETPNSENGTCYPGYFADYEELREQLSSVSSFERFEIFPKERSWPKHNVTRGVTAACSHKGKSSFYRNLLWLTEKNGSYPNLSKSYVNNKEKEVLVLWGVHHPSNIEDQKTIYRKENAYVSVVSSNYNRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1664 - protein, 566 aa, Artificial Sequence; identical to SEQ ID NO: 650
  hemagglutinin__InfluenzaA__ABQ01333

SEQ ID NO: 1665 - protein, 566 aa, Artificial Sequence
  hemagglutinin__InfluenzaA__ABQ01344
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1666 - protein, 562 aa, Artificial Sequence
  hemagglutinin__InfluenzaA__ABQ01355
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRDGLCYPGSFNDYEELKHLLSSVKHFEKVRILPKDRWTQHTTTGGSRACAVSGNPSFFRNMIWLTKKGSNYPVAKGSYNNTSGEQMLIIWGVHHPIDETEQRTLYQNVETYVSVVTSTLNKRSTPKIATRPKVNGLGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQRAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 1667 - protein, 566 aa, Artificial Sequence
  hemagglutinin__InfluenzaA__ABQ01366
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMTNNDNSDKLYIWGVHHPSTDKEQTDLYVQASGKVTVSTKRSQQTIIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1668 - protein, 566 aa, Artificial Sequence; identical to SEQ ID NO: 1433
  hemagglutinin__InfluenzaA__ABQ44383

SEQ ID NO: 1669 - protein, 566 aa, Artificial Sequence; identical to SEQ ID NO: 633
  hemagglutinin__InfluenzaA__ABQ44405

SEQ ID NO: 1670 - protein, 566 aa, Artificial Sequence
  hemagglutinin__InfluenzaA__ABQ44416
MKAKLLVLLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTASCSHKGKSSFYRNLLWLTEKNGSYPNLSKSYVNNKEKEVLVLWGVHHPSNIGDQRAIYHTENAYVSVVSSHYNRRFTPEIAKRPKVRDQEGRINYYWTLLEPEDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1671 - protein, 566 aa, Artificial Sequence; identical to SEQ ID NO: 256
  hemagglutinin__InfluenzaA__ABQ44427

SEQ ID NO: 1672 - protein, 562 aa, Artificial Sequence
  hemagglutinin__InfluenzaA__ABQ44438
MAIIYFILLFTAVRGDQICIGYHANNSTEKVDTILERNVTVTHAKDILEKTHNGKLCKLNGIPPLELGDCSITGWLLGNPECDRLLRVPEWSYIMEKENPRYSLCYPGSFNDYEELKHLLSSVKHFEKVRILPKDGWTQHTTSGGSKACAVSGKSSFFRNMVWLTKKGPNYPVAKRSYNNTSGEQMLIIWGVHHPNDEAEQSALYQKVGTYVSASTSTLNKRSTPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNTQFEAVGKEFSNLEKRLENLNKKMEDGFLDVWTYNAELLVLMENERTLDFHDSNVKNLYNKVRMQLRDNVKELGNGCFEFYHKCDDECMSSVKNGTYDYPKYEEESKLKRNEIKGVKLSSMGVYQILAIYATVAGSLSLAIMIAGISLWMCSNGSLQCRICI

SEQ ID NO: 1673 - protein, 562 aa, Artificial Sequence
  hemagglutinin__InfluenzaA__ABQ44460
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMIWLTKKGSNYPVAKGSYNNTSGEQMLIIWGVHHPNDETEQRTLYQNVGTYVSVGTSTLNKRSTPDIATRPKVNGLGSRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 1674 - protein, 566 aa, Artificial Sequence
  hemagglutinin__InfluenzaA__ABQ44471
MKARLLILLCALSATDADTICIGYHANNSTDTVDTVLEKNVTVTHSVNLLEDSHNGKLCRLKGIAPLQLGKCNIAGWILGNPECESLLSNRSWSYIAETPNSENGTCYPGDFADYEELREQLSSVSSFERFEIFPKERSWPKHNITRGVTAACSHAKKSSFYKNLLWLTEANGSYPNLSKSYVNNKEKEVLVLWGVHHPSNIEDQRTLYRKENAYVSVVSSNYNRRFTPEIAERPKVRGQAGRMNYYWTLLEPGDKIIFEANGNLIAPWYAFALSRGLGSGIITSNASMDECDTKCQTPQGAINNSLPFQNIHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCDNECMESVKNGTYDYPKYSEESKLNREKIDGVKLESMGVYQILAIYSTVASSLVLLVSLGAISFWMCSNGSLQCRICI

SEQ ID NO: 1675 - protein, 566 aa, Artificial Sequence
  hemagglutinin__InfluenzaA__ABR15797
MKTIIALSYIFCLALGQDLPGNDNSTATLCLGHHAVPNGTLVKTITNDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1676 - protein, 566 aa, Artificial Sequence
  hemagglutinin__InfluenzaA__ABR15808
MKARLLILLCALSATDADTICIGYHANNSTDTVDTVLEKNVTVTHSVNLLEDSHNGKLCRLKGIAPLQLGKCNIAGWILGNPECESLLSNRSWSYIAETPNSENGTCYPGDFADYEELREQLSSVSSFERFEIFPKERSWPKHNITRGVTAACSHAKKSSFYKNLLWLTEANGSYPNLSKSYVNNKEKEVLVLWGVHHPSNIEDQRTLYRKENAYVSVVSSNYNRRFTPEIAERPKVRGQAGRMNYYWTLLEPGDKIIFEANGNLIAPWYAFALSRGLGSGIITSNASMDECDTKCQTPQGAINSSLPFQNIHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCDNECMESVKNGTYDYPKYSEESKLNREKIDGVKLESMGVYQILAIYSTVASSLVLLVSLGAISFWMCSNGSLQCRICI

SEQ ID NO: 1677 - protein, 565 aa, Artificial Sequence; identical to SEQ ID NO: 742
  hemagglutinin__InfluenzaA__ABR15885

SEQ ID NO: 1678 - protein, 565 aa, Artificial Sequence
  hemagglutinin__InfluenzaA__ABR15896
MKAKLLVLLCTFTATYADTICIGYHANNSTDTVDTVLEKNVTVTHSVNLLEDSHNGKLCLLKGIAPLQLGNCSVAGWILGNPECELLISKESWSYIVEAPNPENGTCYPGYFADYEELREQLSSVSSFERFEIFPKESSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1679 - protein, 565 aa, Artificial Sequence; identical to SEQ ID NO: 741
  hemagglutinin__InfluenzaA__ABR15907

SEQ ID NO: 1680 - protein, 565 aa, Artificial Sequence; identical to SEQ ID NO: 742
  hemagglutinin__InfluenzaA__ABR15918

SEQ ID NO: 1681 - protein, 566 aa, Artificial Sequence
  hemagglutinin__InfluenzaA__ABR15929
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCNNACIGSIRNGTYDHDVYRDEALNNRFQIKGVELKSGYKDWILWISFAISCFLLCIVLLGFIMWACQKGNIRCNICI

SEQ ID NO: 1682 - protein, 566 aa, Artificial Sequence
  hemagglutinin__InfluenzaA__ABR15940
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSISNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 1683 - protein, 566 aa, Artificial Sequence; identical to SEQ ID NO: 562
  hemagglutinin__InfluenzaA__ABR15951

SEQ ID NO: 1684 - protein, 566 aa, Artificial Sequence
  hemagglutinin__InfluenzaA__ABR15962
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSRAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSIISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1685 - protein, 566 aa, Artificial Sequence
  hemagglutinin__InfluenzaA__ABR22241
MKTIIALSYILCLAFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLEYRYPALNVTMPNNDKFDKLYIWGVHHPSTDSDQISVYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNKLIEKTNEKFHQIEKEFSEVEGRIQDLEKYVEDTKIDLWSYNAELLVALENQNTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1686 - protein, 566 aa, Artificial Sequence; identical to SEQ ID NO: 650
  hemagglutinin__InfluenzaA__ABR28515

SEQ ID NO: 1687 - protein, 566 aa, Artificial Sequence
  hemagglutinin__InfluenzaA__ABR28592
MKTIIALSYVFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1688 - protein, 565 aa, Artificial Sequence; identical to SEQ ID NO: 742
  hemagglutinin__InfluenzaA__ABR28768

SEQ ID NO: 1689 - protein, 565 aa, Artificial Sequence; identical to SEQ ID NO: 742
  hemagglutinin__InfluenzaA__ABR28779

SEQ ID NO: 1690 - protein, 566 aa, Artificial Sequence; identical to SEQ ID NO: 1433
  hemagglutinin__InfluenzaA__ABR28790

SEQ ID NO: 1691 - protein, 565 aa, Artificial Sequence; identical to SEQ ID NO: 742
  hemagglutinin__InfluenzaA__ABR28801

SEQ ID NO: 1692 - protein, 566 aa, Artificial Sequence; identical to SEQ ID NO: 650
  hemagglutinin__InfluenzaA__ABR28812

SEQ ID NO: 1693 - protein, 566 aa, Artificial Sequence
  hemagglutinin__InfluenzaA__ABR28823
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1694 - protein, 565 aa, Artificial Sequence; identical to SEQ ID NO: 870
  hemagglutinin__InfluenzaA__ABR28834

SEQ ID NO: 1695 - protein, 565 aa, Artificial Sequence; identical to SEQ ID NO: 841
  hemagglutinin__InfluenzaA__ABR28845

SEQ ID NO: 1696 - protein, 566 aa, Artificial Sequence
  hemagglutinin__InfluenzaA__ABR28856
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVIMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQKTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1697 - protein, 566 aa, Artificial Sequence; identical to SEQ ID NO: 607
  hemagglutinin__InfluenzaA__ABR28867

SEQ ID NO: 1698 - protein, 566 aa, Artificial Sequence; identical to SEQ ID NO: 562
  hemagglutinin__InfluenzaA__ABR28878

SEQ ID NO: 1699 - protein, 565 aa, Artificial Sequence; identical to SEQ ID NO: 1204
  hemagglutinin__InfluenzaA__ABR28900

SEQ ID NO: 1700 - protein, 566 aa, Artificial Sequence
  hemagglutinin__InfluenzaA__ABR28922
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRVSIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1701 - protein, 566 aa, Artificial Sequence; identical to SEQ ID NO: 1581
  hemagglutinin__InfluenzaA__ABR88080

SEQ ID NO: 1702 - protein, 566 aa, Artificial Sequence
  hemagglutinin__InfluenzaA__ABS00315
MKAKLLVLLCAFTATDADTICIGYHANNSTDTVDTVLEKNVTVTHSVNLLEDSHNGKLCRLKGIAPLQLGNCSVAGWILGNPECESLFSKKSWSYIAETPNSENGTCYPGYFADYEELREQLSSVSSFERFEIFPKESSWPNHTVTKGVSASCSHKGRSSFYRNLLWLTEKNGSYPNLSKSYVNNKEREVLVLWGVHHPSNIGEQRAIYHTENAYVSVVSSHYNRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1703 - protein, 566 aa, Artificial Sequence
  hemagglutinin__InfluenzaA__ABS00326
MKAKLLVLLCAFTATDADTICIGYHANNSTDTVDTVLEKNVTVTHSVNLLEDSHNGKLCRLKGIAPLQLGNCSVAGWILGNPECESLFSKKSWSYIAETPNSENGTCYPGYFADYEELREQLSSVSSFERFEIFPKESSWPNHTVTKGVSASCSHKGRSSFYRNLLWLTEKNGSYPNLSKSYVNNKEKEVLVLWGVHHPSNIGEQRAIYHTENAYVSVVSSHYNRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1704 - protein, 566 aa, Artificial Sequence; identical to SEQ ID NO: 1640
  hemagglutinin__InfluenzaA__ABS49899

SEQ ID NO: 1705 - protein, 566 aa, Artificial Sequence
  hemagglutinin__InfluenzaA__ABS49910
MKTIIALSYIFCLALGQDLPGNDNSTATLCLGHHAVPNGTLVKTITNDQIEVTNATELVQSSSTGKICNNPHRILDGINCTLIDALLGDPHCDVFQDETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQMRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 1706 - protein, 566 aa, Artificial Sequence; identical to SEQ ID NO: 650
  hemagglutinin__InfluenzaA__ABS49965

SEQ ID NO: 1707 - protein, 565 aa, Artificial Sequence
  hemagglutinin__InfluenzaA__ABS49976
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGNQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHNSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1708 - protein, 565 aa, Artificial Sequence
  hemagglutinin__InfluenzaA__ABS49987
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNMKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1709 - protein, 566 aa, Artificial Sequence
  hemagglutinin__InfluenzaA__ABS49998
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVIMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1710 - protein, 566 aa, Artificial Sequence
  hemagglutinin__InfluenzaA__ABS50009
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSKISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1711 - protein, 566 aa, Artificial Sequence; identical to SEQ ID NO: 710
  hemagglutinin__InfluenzaA__ABS50020

SEQ ID NO: 1712 - protein, 566 aa, Artificial Sequence
  hemagglutinin__InfluenzaA__ABS50031
MKTIIALSYMLCLVFAQKLPGNDNSTAMLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSGPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1713 - protein, 566 aa, Artificial Sequence; identical to SEQ ID NO: 51
  hemagglutinin__InfluenzaA__ABS50042

SEQ ID NO: 1714 - protein, 566 aa, Artificial Sequence; identical to SEQ ID NO: 1693
  hemagglutinin__InfluenzaA__ABS50053

SEQ ID NO: 1715 - protein, 566 aa, Artificial Sequence
  hemagglutinin__InfluenzaA__ABS50064
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQTTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVSLENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1716 - protein, 566 aa, Artificial Sequence
  hemagglutinin__InfluenzaA__ABS50075
MKTIIALSYILCLVFAQKLPGNDNSTATLCLGHHAVPNGTIVKTITNDQIEVTNATELVQSSSTGGICDSPHKILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1717 - protein, 565 aa, Artificial Sequence
  hemagglutinin__InfluenzaA__ABS71665
MKVKLLVLLCTFTATYADTICIGYHANNSTDTVDTVLEKNVTVTHSVNLLEDSHNGKLCLLKGIAPLQLGNCSVAGWILGNPECESLISRESWSYIVEKPSPENGTCYPGHFADYEELREQLSSVSSFERFEIFPKESSWPNHTATGVSASCSHNGESSFYKNLLWLTGKNGLYPNLSKSYANNKEKEVLVLWGVHHPPNIGDQRALYHTENAYVSVVSSHYSRKFTPEIAKRPKVRDQEGRISYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1718 - protein, 565 aa, Artificial Sequence
  hemagglutinin__InfluenzaA__ABS71666
MKVKLLVLLCTFTATYADTICIGYHANNSTDTVDTVLEKNVTVTHSVNLLEDSHNGKLCLLKGIAPLQLGNCSVAGWILGNPECESLISRESWSYIVEKPSPENGTCYPGHFADYEELREQLSSVSSFERFEIFPKESSWPNHTATGVSASCSHNGKSSFYKNLLWLTGKNGLYPNLSKSYANNKEKEVLVLWGVHHPPNIGDQRALYHTENAYVSVVSSHYSRKFTPEIAKRPKVRDQEGRISYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1719 - protein, 565 aa, Artificial Sequence
  hemagglutinin__InfluenzaA__ABS71667
MKVKLLVLLCTFTATYADTICIGYHANNSTDTVDTVLEKNVTVTHSVNLLEDSHNGKLCLLKGIAPLQLGNCSVAGWILGNPECESLISRESWSYIVEKPSPENGTCYPGHFADYEELREQLSSVSSFERFEIFPKESSWPNHTATGVSASCSHNGKSSFYKNLLWLTGKNGLYPNLSKSYANNKEKEVLVLWGVHHPPNIGDQRALYHTENAYISVVSSHYSRKFTPEIAKRPKVRDQEGRISYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1720 - protein, 565 aa, Artificial Sequence
  hemagglutinin__InfluenzaA__ABS71668
MKVKLLVLLCTFTATYADTICIGYHANNSTDTVDTVLEKNVTVTHSVNLLEDSHNGKLCLLKGIAPLQLGNCSVAGWILGNPECESLISRESWSYIVEKPSPENGTCYPGHFADYEELREQLSSVSSFERFEIFPKESSWPNHTASGVSASCSHNGKSSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1721 - protein, 565 aa, Artificial Sequence
  hemagglutinin__InfluenzaA__ABS71669
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1722 - protein, 565 aa, Artificial Sequence
  hemagglutinin__InfluenzaA__ABS71671
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEMFPKESSWPNHTVTGVSASCSHNGKSSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1723 - protein, 565 aa, Artificial Sequence
  hemagglutinin__InfluenzaA__ABS71672
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELRERLSSVSSFERFEMFPKESSWPNHTVTGVSASCSHNGKSSFYKNLLWLTGKNGLYPNLSKSYANNKEKEVLVLWGVHHPPNIGAQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 1724 - protein, 565 aa, Artificial Sequence
  hemagglutinin__InfluenzaA__ABS71673
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGRSSFYRNLLWLTGKNGLYPNLSKSYANNKEKEVLVLWGVHHPPNIGDQRALYHTENTYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1725 - protein, 566 aa, Artificial Sequence; identical to SEQ ID NO: 630
  hemagglutinin__InfluenzaA__ABS71674

SEQ ID NO: 1726 - protein, 566 aa, Artificial Sequence
  hemagglutinin__InfluenzaA__ABS71675
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAHSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1727 - protein, 566 aa, Artificial Sequence
  hemagglutinin__InfluenzaA__ABS71676
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFIIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1728 - protein, 566 aa, Artificial Sequence
  hemagglutinin__InfluenzaA__ABS71677
MKTIIALSYILCLVFAQKLPGIDNSTATLCLGHHAVPNGTIVKTITDDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1729 - protein, 566 aa, Artificial Sequence
  hemagglutinin__InfluenzaA__ABS71679
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1730 - protein, 566 aa, Artificial Sequence; identical to SEQ ID NO: 1729
  hemagglutinin__InfluenzaA__ABS71680

SEQ ID NO: 1731 - protein, 566 aa, Artificial Sequence
  hemagglutinin__InfluenzaA__ABS71682
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1732 - protein, 566 aa, Artificial Sequence
  hemagglutinin__InfluenzaA__ABU80177
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSSCKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1733 - protein, 565 aa, Artificial Sequence
  hemagglutinin__InfluenzaA__ABU80298
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYKKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1734 - protein, 566 aa, Artificial Sequence
  hemagglutinin__InfluenzaA__ABU80320
MKTIIALSYILCLVFAQKLPGNDNSTATLCLGHHAVPNGTLVKTITNDQIEVTNATELVQSSSTGGICDSPHQILDGENCTLIDALLGDPHCDSFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSIISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1735 - protein, 566 aa, Artificial Sequence; identical to SEQ ID NO: 1039
  hemagglutinin__InfluenzaA__ABU80331

SEQ ID NO: 1736 - protein, 566 aa, Artificial Sequence
  hemagglutinin__InfluenzaA__ABU80400
MKAILLVLLYTFTAANADTLCIGYHANNSTDTVDTVLEKNVTVTHSVNLLEDRHNGKLCKLRGVAPLHLGKCNIAGWLLGNPECELLFTASSWSYIVETSNSDNGTCYPGDFINYEELREQLSSVSSFERFEIFPKASSWPNHETNRGVTAACPYAGANSFYRNLIWLVKKGNSYPKLSKSYVNNKEKEVLVLWGIHHPPTSTDQQSLYQNADAYVFVGSSKYNKKFKPEIATRPKVRGQAGRMNYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNRKVDDGFLDIWTYNAELLVLLENERTLDYHDSNVKNLYEKVRSQLKNNAKEIGNGCFEFYHKCDDTCMESVKNGTYDYPKYSEESKLNREEIDGVKLESTRIYQILAIYSTVASSLVLLVSLGAISFWMCSNGSLQCRICI

SEQ ID NO: 1737 - protein, 566 aa, Artificial Sequence
  hemagglutinin__InfluenzaA__ABU92572
MKTIIALSYILCLVFTQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1738 - protein, 566 aa, Artificial Sequence
  hemagglutinin__InfluenzaA__ABU92573
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMMDGWYGFRHQNSEGTGQAADLKSTQAAINQINGKLNRLIKKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1739 - protein, 566 aa, Artificial Sequence
  hemagglutinin__InfluenzaA__ABU92575
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSKPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1740 - protein, 566 aa, Artificial Sequence; identical to SEQ ID NO: 51
  hemagglutinin__InfluenzaA__ABU92576

SEQ ID NO: 1741 - protein, 566 aa, Artificial Sequence; identical to SEQ ID NO: 51
  hemagglutinin__InfluenzaA__ABU92577

SEQ ID NO: 1742 - protein, 566 aa, Artificial Sequence; identical to SEQ ID NO: 72
  hemagglutinin__InfluenzaA__ABU92578

SEQ ID NO: 1743 - protein, 566 aa, Artificial Sequence; identical to SEQ ID NO: 72
  hemagglutinin__InfluenzaA__ABU92579

SEQ ID NO: 1744 - protein, 566 aa, Artificial Sequence; identical to SEQ ID NO: 72
  hemagglutinin__InfluenzaA__ABU92580

SEQ ID NO: 1745 - protein, 566 aa, Artificial Sequence; identical to SEQ ID NO: 1737
  hemagglutinin__InfluenzaA__ABU92581

SEQ ID NO: 1746 - protein, 566 aa, Artificial Sequence
  hemagglutinin__InfluenzaA__ABU92582
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPAQNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1747 - protein, 566 aa, Artificial Sequence; identical to SEQ ID NO: 1746
  hemagglutinin__InfluenzaA__ABU92583

SEQ ID NO: 1748 - protein, 566 aa, Artificial Sequence
  hemagglutinin__InfluenzaA__ABU92584
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLRYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQKTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 1749 - protein, 566 aa, Artificial Sequence
  hemagglutinin__InfluenzaA__ABU92586
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKNWILWISFAISCFLLCVALLGFIMWACQKGNIRCNICI

SEQ ID NO: 1750 - protein, 566 aa, Artificial Sequence
  hemagglutinin__InfluenzaA__ABU92587
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTAIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1751 - protein, 566 aa, Artificial Sequence
  hemagglutinin__InfluenzaA__ABU92588
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAEFLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1752 - protein, 566 aa, Artificial Sequence; identical to SEQ ID NO: 633
  hemagglutinin__InfluenzaA__ABU92590

SEQ ID NO: 1753 - protein, 566 aa, Artificial Sequence
  hemagglutinin__InfluenzaA__ABU92591
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1754 - protein, 566 aa, Artificial Sequence; identical to SEQ ID NO: 1753
  hemagglutinin__InfluenzaA__ABU92592

SEQ ID NO: 1755 - protein, 566 aa, Artificial Sequence
  hemagglutinin__InfluenzaA__ABU92593
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWAGQKGNKRCNICI

SEQ ID NO: 1756 - protein, 566 aa, Artificial Sequence
  hemagglutinin__InfluenzaA__ABU92594
MKTIIALSYILCLVFAQKLPGNDNSTATLCLGHHAVPNGTIVKTITNDQIEVTNATELVQSSSTGEICNSPHQILDGESCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALSGFIMWACQKGNIRCNICI

SEQ ID NO: 1757 - protein, 566 aa, Artificial Sequence
  hemagglutinin__InfluenzaA__ABU92595
MKTIIALSYILCLVFAQKLPENDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1758 - protein, 566 aa, Artificial Sequence
  hemagglutinin__InfluenzaA__ABU92596
MKTIIALSYILCLVFAQKLPGNDNSTATLCLGHHAVPNGTMVKTITNDQIEVTNATELVQSSSTGEICDSPHQILDGENCTLIDALLGDPQCDGFQNKKWDLFVERSKAHSNCYPYDVPDYASLRSLIASSGTLEFNNESFNWTGVTQNGTSSACKRRSDNSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSGCITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1759 - protein, 566 aa, Artificial Sequence; identical to SEQ ID NO: 630
  hemagglutinin__InfluenzaA__ABU92597

SEQ ID NO: 1760 - protein, 566 aa, Artificial Sequence; identical to SEQ ID NO: 73
  hemagglutinin__InfluenzaA__ABU92601

SEQ ID NO: 1761 - protein, 566 aa, Artificial Sequence; identical to SEQ ID NO: 73
  hemagglutinin__InfluenzaA__ABU92602

SEQ ID NO: 1762 - protein, 566 aa, Artificial Sequence
  hemagglutinin__InfluenzaA__ABU92603
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1763 - protein, 566 aa, Artificial Sequence; identical to SEQ ID NO: 73
  hemagglutinin__InfluenzaA__ABU92604

SEQ ID NO: 1764 - protein, 566 aa, Artificial Sequence; identical to SEQ ID NO: 1762
  hemagglutinin__InfluenzaA__ABU92605

SEQ ID NO: 1765 - protein, 566 aa, Artificial Sequence; identical to SEQ ID NO: 1762
  hemagglutinin__InfluenzaA__ABU92606

SEQ ID NO: 1766 - protein, 566 aa, Artificial Sequence; identical to SEQ ID NO: 612
  hemagglutinin__InfluenzaA__ABU92608

SEQ ID NO: 1767 - protein, 566 aa, Artificial Sequence; identical to SEQ ID NO: 612
  hemagglutinin__InfluenzaA__ABU92609

SEQ ID NO: 1768 - protein, 566 aa, Artificial Sequence
  hemagglutinin__InfluenzaA__ABU92610
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHSKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRIAYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMSNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1769 - protein, 566 aa, Artificial Sequence
  hemagglutinin__InfluenzaA__ABU92611
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQISLYAQASGKITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIIWACLKGNIRCNICI

SEQ ID NO: 1770 - protein, 566 aa, Artificial Sequence
  hemagglutinin__InfluenzaA__ABU92612
MKTIIALSYILCLVFAQKLPGNDNSTATLCLGHHAVPNGTMVKTITNDQIEVTNATELVQSSSTGGICDSPHQILDGENCTLIDALLGDPQCDGFQNKKWDLFVERSKAHSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNNKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1771 - protein, 566 aa, Artificial Sequence; identical to SEQ ID NO: 1258
  hemagglutinin__InfluenzaA__ABU92613

SEQ ID NO: 1772 - protein, 566 aa, Artificial Sequence; identical to SEQ ID NO: 1757
  hemagglutinin__InfluenzaA__ABU92614

SEQ ID NO: 1773 - protein, 566 aa, Artificial Sequence
  hemagglutinin__InfluenzaA__ABU92615
MKTIIALSYILCLVFAQKLPGNDNSTATLCLGHHAVPNGTIVRTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNVGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1774 - protein, 566 aa, Artificial Sequence
  hemagglutinin__InfluenzaA__ABU92617
MKTIIALSYILCLVFAQKLPGNDNSTATLCLGHHSVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1775 - protein, 566 aa, Artificial Sequence; identical to SEQ ID NO: 1258
  hemagglutinin__InfluenzaA__ABU92619

SEQ ID NO: 1776 - protein, 566 aa, Artificial Sequence; identical to SEQ ID NO: 1757
  hemagglutinin__InfluenzaA__ABU92620

SEQ ID NO: 1777 - protein, 566 aa, Artificial Sequence
  hemagglutinin__InfluenzaA__ABU92622
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRSVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1778 - protein, 566 aa, Artificial Sequence; identical to SEQ ID NO: 73
  hemagglutinin__InfluenzaA__ABU92623

SEQ ID NO: 1779 - protein, 566 aa, Artificial Sequence
  hemagglutinin__InfluenzaA__ABU92624
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQALGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1780 - protein, 566 aa, Artificial Sequence; identical to SEQ ID NO: 1762
  hemagglutinin__InfluenzaA__ABU92625

SEQ ID NO: 1781 - protein, 566 aa, Artificial Sequence; identical to SEQ ID NO: 73
  hemagglutinin__InfluenzaA__ABU92626

SEQ ID NO: 1782 - protein, 566 aa, Artificial Sequence
  hemagglutinin__InfluenzaA__ABU92627
MKTIIALSYILCMVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINRPGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1783 - protein, 566 aa, Artificial Sequence; identical to SEQ ID NO: 1762
  hemagglutinin__InfluenzaA__ABU92628

SEQ ID NO: 1784 - protein, 566 aa, Artificial Sequence; identical to SEQ ID NO: 1762
  hemagglutinin__InfluenzaA__ABU92631

SEQ ID NO: 1785 - protein, 566 aa, Artificial Sequence
  hemagglutinin__InfluenzaA__ABU92632
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHLNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1786 - protein, 566 aa, Artificial Sequence
  hemagglutinin__InfluenzaA__ABU92635
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSIVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1787 - protein, 566 aa, Artificial Sequence; identical to SEQ ID NO: 630
  hemagglutinin__InfluenzaA__ABU92636

SEQ ID NO: 1788 - protein, 566 aa, Artificial Sequence
  hemagglutinin__InfluenzaA__ABU92637
MKTIIALSYILCLVFAQKLPGNDNSTATLCLGHHAVPNGTTVKTITNDQIEVTNATELVQSSSTGGICDSPHQILDGENCTLIDALLGDPQCDGFQNKKWDLFVERSKAYSNCYPYDVPDYVSLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1789 - protein, 566 aa, Artificial Sequence
  hemagglutinin__InfluenzaA__ABU92639
MKTIIALSYILCLVFAQKLPGNDNSTATLCLGHHAVPNGTIVKTITNDQIEVTNATELVQISSTGEICDSPHQILDGENCTLIDALLGDPQCDGFQNTKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYIEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1790 - protein, 566 aa, Artificial Sequence
  hemagglutinin__InfluenzaA__ABU92640
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCAALLGFIMWACQKGNIRCNICI

SEQ ID NO: 1791 - protein, 566 aa, Artificial Sequence
  hemagglutinin__InfluenzaA__ABU92641
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1792 - protein, 566 aa, Artificial Sequence
  hemagglutinin__InfluenzaA__ABU92642
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRIIVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1793 - protein, 566 aa, Artificial Sequence
  hemagglutinin__InfluenzaA__ABU92643
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 1794 - protein, 566 aa, Artificial Sequence
  hemagglutinin__InfluenzaA__ABU92645
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRIAYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGIELKSGYKDWILWISFAISCFLLCVVLLGFIMWACQKGNIRCNICI

SEQ ID NO: 1795 - protein, 566 aa, Artificial Sequence
  hemagglutinin__InfluenzaA__ABU92646
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1796 - protein, 566 aa, Artificial Sequence; identical to SEQ ID NO: 73
  hemagglutinin__InfluenzaA__ABU92647

SEQ ID NO: 1797 - protein, 566 aa, Artificial Sequence
  hemagglutinin__InfluenzaA__ABU92648
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFNWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1798 - protein, 566 aa, Artificial Sequence; identical to SEQ ID NO: 73
  hemagglutinin__InfluenzaA__ABU92649

SEQ ID NO: 1799 - protein, 566 aa, Artificial Sequence; identical to SEQ ID NO: 1762
  hemagglutinin__InfluenzaA__ABU92650

SEQ ID NO: 1800 - protein, 566 aa, Artificial Sequence
  hemagglutinin__InfluenzaA__ABU92651
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFYNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1801 - protein, 566 aa, Artificial Sequence
  hemagglutinin__InfluenzaA__ABU92652
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDIGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1802 - protein, 566 aa, Artificial Sequence; identical to SEQ ID NO: 1762
  hemagglutinin__InfluenzaA__ABU92653

SEQ ID NO: 1803 - protein, 566 aa, Artificial Sequence
  hemagglutinin__InfluenzaA__ABU92654
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGKITVSTKRSQQTVIPNIGSRPRVRDVPSRISIYWTIVKPGDILLINSTGNLIAPRGYFKIRSGKSSIMRSDAPIGKCNSECITPNGSILNDKPFQNVNRITYGACPRYVKQNTLKLATGMRNVPEKQTRGIFGAIAGFIENGWEGMVDGWYGFRHQNAEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1804 - protein, 566 aa, Artificial Sequence
  hemagglutinin__InfluenzaA__ABU92655
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNAEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1805 - protein, 566 aa, Artificial Sequence; identical to SEQ ID NO: 1762
  hemagglutinin__InfluenzaA__ABU92656

SEQ ID NO: 1806 - protein, 566 aa, Artificial Sequence; identical to SEQ ID NO: 633
  hemagglutinin__InfluenzaA__ABU92657

SEQ ID NO: 1807 - protein, 566 aa, Artificial Sequence; identical to SEQ ID NO: 1762
  hemagglutinin__InfluenzaA__ABU92658

SEQ ID NO: 1808 - protein, 566 aa, Artificial Sequence; identical to SEQ ID NO: 633
  hemagglutinin__InfluenzaA__ABU92659

SEQ ID NO: 1809 - protein, 566 aa, Artificial Sequence; identical to SEQ ID NO: 1762
  hemagglutinin__InfluenzaA__ABU92660

SEQ ID NO: 1810 - protein, 566 aa, Artificial Sequence
  hemagglutinin__InfluenzaA__ABU92661
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELESGYKDWILWISFAISCFLLCVALLGFIMWACQKGNIRCNICI

SEQ ID NO: 1811 - protein, 566 aa, Artificial Sequence; identical to SEQ ID NO: 73
  hemagglutinin__InfluenzaA__ABU92662

SEQ ID NO: 1812 - protein, 566 aa, Artificial Sequence; identical to SEQ ID NO: 1762
  hemagglutinin__InfluenzaA__ABU92663

SEQ ID NO: 1813 - protein, 566 aa, Artificial Sequence; identical to SEQ ID NO: 1762
  hemagglutinin__InfluenzaA__ABU92664

SEQ ID NO: 1814 - protein, 566 aa, Artificial Sequence
  hemagglutinin__InfluenzaA__ABU92665
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVTQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1815 - protein, 566 aa, Artificial Sequence; identical to SEQ ID NO: 1762
  hemagglutinin__InfluenzaA__ABU92666

SEQ ID NO: 1816 - protein, 566 aa, Artificial Sequence; identical to SEQ ID NO: 72
  hemagglutinin__InfluenzaA__ABU92667

SEQ ID NO: 1817 - protein, 566 aa, Artificial Sequence; identical to SEQ ID NO: 72
  hemagglutinin__InfluenzaA__ABU92668

SEQ ID NO: 1818 - protein, 566 aa, Artificial Sequence
  hemagglutinin__InfluenzaA__ABU92669
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRNGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1819 - protein, 566 aa, Artificial Sequence; identical to SEQ ID NO: 72
  hemagglutinin__InfluenzaA__ABU92670

SEQ ID NO: 1820 - protein, 566 aa, Artificial Sequence
  hemagglutinin__InfluenzaA__ABU92671
MKTIIALSHILCLVFAQKLPVNDNSTATLCLGHHAVPNGTLVKTITNDHIEVTNATELVQSSSTGRICDIPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEAEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1821 - protein, 566 aa, Artificial Sequence; identical to SEQ ID NO: 72
  hemagglutinin__InfluenzaA__ABU92672

SEQ ID NO: 1822 - protein, 566 aa, Artificial Sequence; identical to SEQ ID NO: 72
  hemagglutinin__InfluenzaA__ABU92673

SEQ ID NO: 1823 - protein, 566 aa, Artificial Sequence
  hemagglutinin__InfluenzaA__ABU92674
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERRTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1824 - protein, 566 aa, Artificial Sequence
  hemagglutinin__InfluenzaA__ABU92675
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACMGSIRNGTYDHDVYRDEALNNRFQIKGVELKSGYKDWILWISFAISCFLLCVALLGFIMWACQKGNIRCNICI

SEQ ID NO: 1825 - protein, 566 aa, Artificial Sequence; identical to SEQ ID NO: 633
  hemagglutinin__InfluenzaA__ABU92676

SEQ ID NO: 1826 - protein, 566 aa, Artificial Sequence; identical to SEQ ID NO: 1753
  hemagglutinin__InfluenzaA__ABU92677

SEQ ID NO: 1827 - protein, 566 aa, Artificial Sequence
  hemagglutinin__InfluenzaA__ABU92678
MKTIIALSYILCLVFAQKLPGNDNSTATLCLGHHAVPNGTIVKTITNDQIEVTNATELVQSSSTGGICDSPHQILDGENCTLIDALLGDPQCDGLQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1828 - protein, 566 aa, Artificial Sequence
  hemagglutinin__InfluenzaA__ABU92680
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1829 - protein, 566 aa, Artificial Sequence; identical to SEQ ID NO: 1757
  hemagglutinin__InfluenzaA__ABU92681

SEQ ID NO: 1830 - protein, 566 aa, Artificial Sequence; identical to SEQ ID NO: 73
  hemagglutinin__InfluenzaA__ABU92682

SEQ ID NO: 1831 - protein, 566 aa, Artificial Sequence; identical to SEQ ID NO: 1762
  hemagglutinin__InfluenzaA__ABU92683

SEQ ID NO: 1832 - protein, 566 aa, Artificial Sequence
  hemagglutinin__InfluenzaA__ABU92684
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFIERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQAPGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1833 - protein, 566 aa, Artificial Sequence
  hemagglutinin__InfluenzaA__ABU92685
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1834 - protein, 566 aa, Artificial Sequence; identical to SEQ ID NO: 1762
  hemagglutinin__InfluenzaA__ABU92686

SEQ ID NO: 1835 - protein, 566 aa, Artificial Sequence; identical to SEQ ID NO: 1762
  hemagglutinin__InfluenzaA__ABU92687

SEQ ID NO: 1836 - protein, 566 aa, Artificial Sequence; identical to SEQ ID NO: 1795
  hemagglutinin__InfluenzaA__ABU92688

SEQ ID NO: 1837 - protein, 566 aa, Artificial Sequence; identical to SEQ ID NO: 1762
  hemagglutinin__InfluenzaA__ABU92689

SEQ ID NO: 1838 - protein, 566 aa, Artificial Sequence
  hemagglutinin__InfluenzaA__ABU92691
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSVMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDIGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 1839 - protein, 566 aa, Artificial Sequence; identical to SEQ ID NO: 690
  hemagglutinin__InfluenzaA__ABU92692

SEQ ID NO: 1840 - protein, 566 aa, Artificial Sequence
  hemagglutinin__InfluenzaA__ABU92693
MKAIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1841 - protein, 566 aa, Artificial Sequence
  hemagglutinin__InfluenzaA__ABU92694
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKVDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1842 - protein, 566 aa, Artificial Sequence; identical to SEQ ID NO: 1753
  hemagglutinin__InfluenzaA__ABU92695

SEQ ID NO: 1843 - protein, 566 aa, Artificial Sequence
  hemagglutinin__InfluenzaA__ABU92696
MKTIIALGYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1844 - protein, 566 aa, Artificial Sequence; identical to SEQ ID NO: 633
  hemagglutinin__InfluenzaA__ABU92697

SEQ ID NO: 1845 - protein, 566 aa, Artificial Sequence; identical to SEQ ID NO: 243
  hemagglutinin__InfluenzaA__ABU92698

SEQ ID NO: 1846 - protein, 566 aa, Artificial Sequence
  hemagglutinin__InfluenzaA__ABU92699
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1847 - protein, 566 aa, Artificial Sequence
  hemagglutinin__InfluenzaA__ABU92700
MKTIIALSYILCLVFAQKLPENDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNERFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1848 - protein, 566 aa, Artificial Sequence
  hemagglutinin__InfluenzaA__ABU92701
MKTIIALSYILCLVFAQKLPENDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNERFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRLQIKGVELKSGYKDWILWISFAISCFLLCVALLGFIMWACQKGNIRCNICI

SEQ ID NO: 1849 - protein, 566 aa, Artificial Sequence; identical to SEQ ID NO: 612
  hemagglutinin__InfluenzaA__ABU92702

SEQ ID NO: 1850 - protein, 566 aa, Artificial Sequence; identical to SEQ ID NO: 1828
  hemagglutinin__InfluenzaA__ABU92703

SEQ ID NO: 1851 - protein, 566 aa, Artificial Sequence
  hemagglutinin__InfluenzaA__ABU92704
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERNKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1852 - protein, 566 aa, Artificial Sequence
  hemagglutinin__InfluenzaA__ABU92705
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQISLYAQAPGRITVSTKRSQQTVIPNIGSRPRVRDIPSRISIYWTIVKPGDILLINSTGNLIAPRGYFKIRSGKSSIMRSDAPIGKCKSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFRIKSVELKSGYKDWILWISFAISCFLLCVALLGFIMWACQKGNIRCNICI

SEQ ID NO: 1853 - protein, 566 aa, Artificial Sequence; identical to SEQ ID NO: 73
  hemagglutinin__InfluenzaA__ABU92706

SEQ ID NO: 1854 - protein, 566 aa, Artificial Sequence; identical to SEQ ID NO: 1762
  hemagglutinin__InfluenzaA__ABU92707

SEQ ID NO: 1855 - protein, 566 aa, Artificial Sequence; identical to SEQ ID NO: 1762
  hemagglutinin__InfluenzaA__ABU92708

SEQ ID NO: 1856 - protein, 566 aa, Artificial Sequence
  hemagglutinin__InfluenzaA__ABU92709
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 1857 - protein, 566 aa, Artificial Sequence; identical to SEQ ID NO: 51
  hemagglutinin__InfluenzaA__ABU92710

SEQ ID NO: 1858 - protein, 566 aa, Artificial Sequence; identical to SEQ ID NO: 73
  hemagglutinin__InfluenzaA__ABU92711

SEQ ID NO: 1859 - protein, 566 aa, Artificial Sequence; identical to SEQ ID NO: 73
  hemagglutinin__InfluenzaA__ABU92712

SEQ ID NO: 1860 - protein, 566 aa, Artificial Sequence; identical to SEQ ID NO: 1762
  hemagglutinin__InfluenzaA__ABU92713

SEQ ID NO: 1861 - protein, 566 aa, Artificial Sequence; identical to SEQ ID NO: 1762
  hemagglutinin__InfluenzaA__ABU92714

SEQ ID NO: 1862 - protein, 566 aa, Artificial Sequence
  hemagglutinin__InfluenzaA__ABU92715
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFEKLYIWGVHHPGTDSDQINLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1863 - protein, 566 aa, Artificial Sequence; identical to SEQ ID NO: 1762
  hemagglutinin__InfluenzaA__ABU92716

SEQ ID NO: 1864 - protein, 566 aa, Artificial Sequence; identical to SEQ ID NO: 1762
  hemagglutinin__InfluenzaA__ABU92717

SEQ ID NO: 1865 - protein, 566 aa, Artificial Sequence; identical to SEQ ID NO: 73
  hemagglutinin__InfluenzaA__ABU92718

SEQ ID NO: 1866 - protein, 566 aa, Artificial Sequence; identical to SEQ ID NO: 73
  hemagglutinin__InfluenzaA__ABU92719

SEQ ID NO: 1867 - protein, 566 aa, Artificial Sequence
  hemagglutinin__InfluenzaA__ABU92720
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYSSLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1868 - protein, 566 aa, Artificial Sequence
  hemagglutinin__InfluenzaA__ABU92721
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVTPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1869 - protein, 566 aa, Artificial Sequence; identical to SEQ ID NO: 1753
  hemagglutinin__InfluenzaA__ABU92722

SEQ ID NO: 1870 - protein, 566 aa, Artificial Sequence; identical to SEQ ID NO: 73
  hemagglutinin__InfluenzaA__ABU92723

SEQ ID NO: 1871 - protein, 566 aa, Artificial Sequence; identical to SEQ ID NO: 1856
  hemagglutinin__InfluenzaA__ABU92724

SEQ ID NO: 1872 - protein, 566 aa, Artificial Sequence
  hemagglutinin__InfluenzaA__ABU92725
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQINLYAQASGRITVSTKRSQQTVIPNIGSRPRVRDVPSRISIYWTIVKPGDLLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1873 - protein, 566 aa, Artificial Sequence; identical to SEQ ID NO: 1856
  hemagglutinin__InfluenzaA__ABU92726

SEQ ID NO: 1874 - protein, 566 aa, Artificial Sequence
  hemagglutinin__InfluenzaA__ABU92727
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEDFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1875 - protein, 566 aa, Artificial Sequence
  hemagglutinin__InfluenzaA__ABU92728
MKTIIALSYILCQVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1876 - protein, 566 aa, Artificial Sequence; identical to SEQ ID NO: 1875
  hemagglutinin__InfluenzaA__ABU92729

SEQ ID NO: 1877 - protein, 566 aa, Artificial Sequence; identical to SEQ ID NO: 1753
  hemagglutinin__InfluenzaA__ABU92730

SEQ ID NO: 1878 - protein, 566 aa, Artificial Sequence
  hemagglutinin__InfluenzaA__ABU92731
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYVWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1879 - protein, 566 aa, Artificial Sequence
  hemagglutinin__InfluenzaA__ABU92732
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1880 - protein, 566 aa, Artificial Sequence
  hemagglutinin__InfluenzaA__ABU92733
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFIERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKVDLWSYNAELLVALENQHTIDLTDSEMNKLFERTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 1881 - protein, 566 aa, Artificial Sequence; identical to SEQ ID NO: 1753
  hemagglutinin__InfluenzaA__ABU92734

SEQ ID NO: 1882 - protein, 566 aa, Artificial Sequence
  hemagglutinin__InfluenzaA__ABU92735
MKTIIALSYILCLVFAQKLPGNDNSTATLCLGHHAVPNGTIVKTITNDQIEVTNATELVQSSSTGGICGSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQAPARITVSTKRSQQTVIPNIGSRPRVRDIPSRISIYWTIVKPGDILLINSTGNLIAPRGYFKILSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 1883 - protein, 566 aa, Artificial Sequence; identical to SEQ ID NO: 1828
  hemagglutinin__InfluenzaA__ABU92737

SEQ ID NO: 1884 - protein, 566 aa, Artificial Sequence
  hemagglutinin__InfluenzaA__ABU92738
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEKFDKLYIWGVHHPGTDNDQISLYAQAPGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1885 - protein, 566 aa, Artificial Sequence; identical to SEQ ID NO: 1762
  hemagglutinin__InfluenzaA__ABU92739

SEQ ID NO: 1886 - protein, 566 aa, Artificial Sequence
  hemagglutinin__InfluenzaA__ABU92740
MKTIIALSYILCLVFAQKLPGNDNSTATLCLGHHAVPNGTIVKTITNDQIEVTNATELVQSSSTGEICDSPHQILDGENCTLIDTLLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1887 - protein, 566 aa, Artificial Sequence
  hemagglutinin__InfluenzaA__ABU92741
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQISLYAQAPGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDIYRDEALNNRFQIKGVELKSGYKDWILWISFAISCFLLCVVLLGFIMWACQKGNIRCNICI

SEQ ID NO: 1888 - protein, 566 aa, Artificial Sequence; identical to SEQ ID NO: 1828
  hemagglutinin__InfluenzaA__ABU92742

SEQ ID NO: 1889 - protein, 566 aa, Artificial Sequence
  hemagglutinin__InfluenzaA__ABU92743
MKTIIALSYILYLVFAQKLPENDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1890 - protein, 566 aa, Artificial Sequence; identical to SEQ ID NO: 1828
  hemagglutinin__InfluenzaA__ABU92744

SEQ ID NO: 1891 - protein, 566 aa, Artificial Sequence
  hemagglutinin__InfluenzaA__ABU92745
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQISLYAQAPGRITVSTKRSQQTVIPNIGSRPRVRDIPSRISIYWTIVKPGDILLINSTGNLIAPRGYFKIRIGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1892 - protein, 566 aa, Artificial Sequence; identical to SEQ ID NO: 1828
  hemagglutinin__InfluenzaA__ABU92746

SEQ ID NO: 1893 - protein, 566 aa, Artificial Sequence; identical to SEQ ID NO: 73
  hemagglutinin__InfluenzaA__ABU92747

SEQ ID NO: 1894 - protein, 566 aa, Artificial Sequence
  hemagglutinin__InfluenzaA__ABU92748
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHSKFKYPALNVTMPNNEKFDKLYIWGVHHPGTDNDQTFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 1895 - protein, 566 aa, Artificial Sequence; identical to SEQ ID NO: 73
  hemagglutinin__InfluenzaA__ABU92749

SEQ ID NO: 1896 - protein, 566 aa, Artificial Sequence
  hemagglutinin__InfluenzaA__ABU92750
MKTIIALSYILCLVFAQKLPGNDNRTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1897 - protein, 566 aa, Artificial Sequence
  hemagglutinin__InfluenzaA__ABU92751
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1898 - protein, 566 aa, Artificial Sequence; identical to SEQ ID NO: 1762
  hemagglutinin__InfluenzaA__ABU92752

SEQ ID NO: 1899 - protein, 566 aa, Artificial Sequence; identical to SEQ ID NO: 73
  hemagglutinin__InfluenzaA__ABU92753

SEQ ID NO: 1900 - protein, 566 aa, Artificial Sequence; identical to SEQ ID NO: 1762
  hemagglutinin__InfluenzaA__ABU92754

SEQ ID NO: 1901 - protein, 566 aa, Artificial Sequence
  hemagglutinin__InfluenzaA__ABU92755
MKTIIALSYILCLVFAQKLPGNDNGTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNAEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHNVYRDEALNNRFQIKGVELKSGYKDWILWISFAISCFLLCVVLLGFIMWACQKGNIRCNICI

SEQ ID NO: 1902 - protein, 566 aa, Artificial Sequence
  hemagglutinin__InfluenzaA__ABU92756
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAHSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1903 - protein, 566 aa, Artificial Sequence
  hemagglutinin__InfluenzaA__ABU92757
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRRGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1904 - protein, 566 aa, Artificial Sequence; identical to SEQ ID NO: 1762
  hemagglutinin__InfluenzaA__ABU92758

SEQ ID NO: 1905 - protein, 566 aa, Artificial Sequence; identical to SEQ ID NO: 1762
  hemagglutinin__InfluenzaA__ABU92759

SEQ ID NO: 1906 - protein, 566 aa, Artificial Sequence
  hemagglutinin__InfluenzaA__ABU92760
MKTIIALSYILCLVFAQKLPGNDNSTATLCLGHHAVPNGTIVKTITNDQIEVTNATELVQISSTGEICNSPHQILDGENCTLIDALLGDPQCDGFQNKKWDLFVERSKAYSNCYPYDVPDYASLRSLVASSGTLEFNNESFDWTGVTQNGTSSACKRRSDKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1907 - protein, 565 aa, Artificial Sequence
  hemagglutinin__InfluenzaA__ABV29579
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1908 - protein, 565 aa, Artificial Sequence
  hemagglutinin__InfluenzaA__ABV29612
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEVAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1909 - protein, 565 aa, Artificial Sequence
  hemagglutinin__InfluenzaA__ABV29634
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEAPSPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1910 - protein, 565 aa, Artificial Sequence
  hemagglutinin__InfluenzaA__ABV29645
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1911 - protein, 565 aa, Artificial Sequence; identical to SEQ ID NO: 1910
  hemagglutinin__InfluenzaA__ABV29667

SEQ ID NO: 1912 - protein, 565 aa, Artificial Sequence
  hemagglutinin__InfluenzaA__ABV29678
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPVDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1913 - protein, 565 aa, Artificial Sequence
  hemagglutinin__InfluenzaA__ABV29689
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWIGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1914 - protein, 565 aa, Artificial Sequence
  hemagglutinin__InfluenzaA__ABV29700
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1915 - protein, 566 aa, Artificial Sequence
  hemagglutinin__InfluenzaA__ABV29711
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1916 - protein, 566 aa, Artificial Sequence
  hemagglutinin__InfluenzaA__ABV29722
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFLEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1917 - protein, 565 aa, Artificial Sequence
  hemagglutinin__InfluenzaA__ABV29733
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGESSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDKCDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCDDECMESVKNGTYDYPKYSEESKLNREKIDGVKLESMGVYQILAIYSTVASSLVLLVSLGAISFWMCSNGSLQCRICI

SEQ ID NO: 1918 - protein, 565 aa, Artificial Sequence; identical to SEQ ID NO: 1910
  hemagglutinin__InfluenzaA__ABV29744

SEQ ID NO: 1919 - protein, 565 aa, Artificial Sequence
  hemagglutinin__InfluenzaA__ABV29755
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPSPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1920 - protein, 565 aa, Artificial Sequence; identical to SEQ ID NO: 1910
  hemagglutinin__InfluenzaA__ABV29766

SEQ ID NO: 1921 - protein, 565 aa, Artificial Sequence
  hemagglutinin__InfluenzaA__ABV29777
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGESSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDKCDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1922 - protein, 565 aa, Artificial Sequence; identical to SEQ ID NO: 1910
  hemagglutinin__InfluenzaA__ABV29788

SEQ ID NO: 1923 - protein, 565 aa, Artificial Sequence; identical to SEQ ID NO: 1914
  hemagglutinin__InfluenzaA__ABV29799

SEQ ID NO: 1924 - protein, 566 aa, Artificial Sequence
  hemagglutinin__InfluenzaA__ABV29821
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQVFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIKCNICI

SEQ ID NO: 1925 - protein, 565 aa, Artificial Sequence; identical to SEQ ID NO: 1914
  hemagglutinin__InfluenzaA__ABV29832

SEQ ID NO: 1926 - protein, 565 aa, Artificial Sequence; identical to SEQ ID NO: 1910
  hemagglutinin__InfluenzaA__ABV29865

SEQ ID NO: 1927 - protein, 565 aa, Artificial Sequence; identical to SEQ ID NO: 1910
  hemagglutinin__InfluenzaA__ABV29876

SEQ ID NO: 1928 - protein, 566 aa, Artificial Sequence
  hemagglutinin__InfluenzaA__ABV29898
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1929 - protein, 566 aa, Artificial Sequence
  hemagglutinin__InfluenzaA__ABV29909
MKTIIALSYILCLVFAQKLPGNDNSTATLCLGHHAVPNGTIVKTITSDQIEVTNATELVQNSSIGGICNSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQISLYAQAPGRITVSTKRSQQTVIPNIGSRPRVRDIPSRISIYWTIVKPGDILLINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1930 - protein, 565 aa, Artificial Sequence
  hemagglutinin__InfluenzaA__ABV29920
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1931 - protein, 565 aa, Artificial Sequence; identical to SEQ ID NO: 1921
  hemagglutinin__InfluenzaA__ABV29942

SEQ ID NO: 1932 - protein, 565 aa, Artificial Sequence; identical to SEQ ID NO: 1914
  hemagglutinin__InfluenzaA__ABV29953

SEQ ID NO: 1933 - protein, 565 aa, Artificial Sequence; identical to SEQ ID NO: 1914
  hemagglutinin__InfluenzaA__ABV29964

SEQ ID NO: 1934 - protein, 565 aa, Artificial Sequence; identical to SEQ ID NO: 1910
  hemagglutinin__InfluenzaA__ABV29986

SEQ ID NO: 1935 - protein, 565 aa, Artificial Sequence; identical to SEQ ID NO: 1914
  hemagglutinin__InfluenzaA__ABV29997

SEQ ID NO: 1936 - protein, 565 aa, Artificial Sequence; identical to SEQ ID NO: 1910
  hemagglutinin__InfluenzaA__ABV30008

SEQ ID NO: 1937 - protein, 565 aa, Artificial Sequence; identical to SEQ ID NO: 1914
  hemagglutinin__InfluenzaA__ABV30019

SEQ ID NO: 1938 - protein, 565 aa, Artificial Sequence; identical to SEQ ID NO: 1914
  hemagglutinin__InfluenzaA__ABV30030

SEQ ID NO: 1939 - protein, 565 aa, Artificial Sequence
  hemagglutinin__InfluenzaA__ABV30041
MKVKLLVLLCTFTATYADTICIGYHANNSTDTVDTVLEKNVTVTHSVNLLEDSHNGKLCLLKGTAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLISLGAISFWMCSNGSLQCRICI

SEQ ID NO: 1940 - protein, 566 aa, Artificial Sequence; identical to SEQ ID NO: 1928
  hemagglutinin__InfluenzaA__ABV30063

SEQ ID NO: 1941 - protein, 566 aa, Artificial Sequence; identical to SEQ ID NO: 1928
  hemagglutinin__InfluenzaA__ABV30074

SEQ ID NO: 1942 - protein, 565 aa, Artificial Sequence; identical to SEQ ID NO: 1914
  hemagglutinin__InfluenzaA__ABV30085

SEQ ID NO: 1943 - protein, 565 aa, Artificial Sequence; identical to SEQ ID NO: 1914
  hemagglutinin__InfluenzaA__ABV30096

SEQ ID NO: 1944 - protein, 565 aa, Artificial Sequence; identical to SEQ ID NO: 1910
  hemagglutinin__InfluenzaA__ABV30107

SEQ ID NO: 1945 - protein, 565 aa, Artificial Sequence
  hemagglutinin__InfluenzaA__ABV30129
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGNFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1946 - protein, 565 aa, Artificial Sequence
  hemagglutinin__InfluenzaA__ABV30140
MKVKLLVLLCTFTATYADTICIGYHANNSTDTVDTVLEKNVTVTHSVNLLEDRHNGKLCLLKGIAPLKLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSRSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1947 - protein, 565 aa, Artificial Sequence
  hemagglutinin__InfluenzaA__ABV30151
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHSGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1948 - protein, 565 aa, Artificial Sequence
  hemagglutinin__InfluenzaA__ABV30162
MKVKLLVLLCTFTATYADTICIGYHANNSTDTVDTVLEKNVTVTHSVNLLEDSHNGKLCLLKGIAPLQLGNCSVAGWILGNPECELLISRESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1949 - protein, 565 aa, Artificial Sequence; identical to SEQ ID NO: 1914
  hemagglutinin__InfluenzaA__ABV30173

SEQ ID NO: 1950 - protein, 565 aa, Artificial Sequence; identical to SEQ ID NO: 1914
  hemagglutinin__InfluenzaA__ABV30184

SEQ ID NO: 1951 - protein, 566 aa, Artificial Sequence; identical to SEQ ID NO: 1928
  hemagglutinin__InfluenzaA__ABV30217

SEQ ID NO: 1952 - protein, 566 aa, Artificial Sequence; identical to SEQ ID NO: 1928
  hemagglutinin__InfluenzaA__ABV30228

SEQ ID NO: 1953 - protein, 566 aa, Artificial Sequence
  hemagglutinin__InfluenzaA__ABV30261
MKTIIALSYILCLVFAQKLPGIDNSTATLCLGHHAVPNGTIVKTITNDQVEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGMGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRAEALNNRFQIKGVELKSGYKDWILWISFAISCFLLCVALLGFIMWACQKGNIRCNICI

SEQ ID NO: 1954 - protein, 566 aa, Artificial Sequence
  hemagglutinin__InfluenzaA__ABV30272
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSKLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1955 - protein, 565 aa, Artificial Sequence
  hemagglutinin__InfluenzaA__ABV30283
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGNFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1956 - protein, 565 aa, Artificial Sequence
  hemagglutinin__InfluenzaA__ABV30294
MKVKLLVLLCTFTATYADTICIGYHANNSTDTVDTVLEKNVTVTHSVNLLEDRHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSRSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1957 - protein, 565 aa, Artificial Sequence
  hemagglutinin__InfluenzaA__ABV30305
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGGSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 1958 - protein, 565 aa, Artificial Sequence; identical to SEQ ID NO: 1910
  hemagglutinin__InfluenzaA__ABV30316

SEQ ID NO: 1959 - protein, 565 aa, Artificial Sequence; identical to SEQ ID NO: 1956
  hemagglutinin__InfluenzaA__ABV30327

SEQ ID NO: 1960 - protein, 565 aa, Artificial Sequence; identical to SEQ ID NO: 1910
  hemagglutinin__InfluenzaA__ABV30338

SEQ ID NO: 1961 - protein, 565 aa, Artificial Sequence; identical to SEQ ID NO: 1914
  hemagglutinin__InfluenzaA__ABV30349

SEQ ID NO: 1962 - protein, 565 aa, Artificial Sequence
  hemagglutinin__InfluenzaA__ABV30360
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGNFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGIKLESMGVYQILAIYSTVASSLVLLVSLGAISFWMCSNGSLQCRICI

SEQ ID NO: 1963 - protein, 565 aa, Artificial Sequence; identical to SEQ ID NO: 1914
  hemagglutinin__InfluenzaA__ABV30371

SEQ ID NO: 1964 - protein, 566 aa, Artificial Sequence; identical to SEQ ID NO: 1729
  hemagglutinin__InfluenzaA__ABV30382

SEQ ID NO: 1965 - protein, 566 aa, Artificial Sequence; identical to SEQ ID NO: 630
  hemagglutinin__InfluenzaA__ABV30393

SEQ ID NO: 1966 - protein, 566 aa, Artificial Sequence
  hemagglutinin__InfluenzaA__ABV30404
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSKCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNADLLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1967 - protein, 566 aa, Artificial Sequence
  hemagglutinin__InfluenzaA__ABV30415
MKTIIALSYILCLVFAQKLPGIDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKSVELKSGYKDWILWISFAISCFLLCVALLGFIMWACQKGNIRCNICI

SEQ ID NO: 1968 - protein, 566 aa, Artificial Sequence; identical to SEQ ID NO: 1928
  hemagglutinin__InfluenzaA__ABV30426

SEQ ID NO: 1969 - protein, 566 aa, Artificial Sequence
  hemagglutinin__InfluenzaA__ABV30437
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNHSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1970 - protein, 566 aa, Artificial Sequence; identical to SEQ ID NO: 1928
  hemagglutinin__InfluenzaA__ABV30448

SEQ ID NO: 1971 - protein, 565 aa, Artificial Sequence
  hemagglutinin__InfluenzaA__ABV30459
MKVKLLILLCTFTATYADTICIGYHANNSTDTVDTVLEKNVTVTHSVNLLEDSHNGKLCLLKGIAPLQLGNCSVAGWILGNPECELLISKESWSYIVEAPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1972 - protein, 566 aa, Artificial Sequence; identical to SEQ ID NO: 1928
  hemagglutinin__InfluenzaA__ABV30470

SEQ ID NO: 1973 - protein, 565 aa, Artificial Sequence; identical to SEQ ID NO: 1910
  hemagglutinin__InfluenzaA__ABV30492

SEQ ID NO: 1974 - protein, 565 aa, Artificial Sequence
  hemagglutinin__InfluenzaA__ABV30503
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTITGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1975 - protein, 566 aa, Artificial Sequence; identical to SEQ ID NO: 1928
  hemagglutinin__InfluenzaA__ABV30514

SEQ ID NO: 1976 - protein, 565 aa, Artificial Sequence
  hemagglutinin__InfluenzaA__ABV30525
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHSGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNTPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1977 - protein, 565 aa, Artificial Sequence; identical to SEQ ID NO: 1914
  hemagglutinin__InfluenzaA__ABV30536

SEQ ID NO: 1978 - protein, 565 aa, Artificial Sequence; identical to SEQ ID NO: 1921
  hemagglutinin__InfluenzaA__ABV30547

SEQ ID NO: 1979 - protein, 565 aa, Artificial Sequence; identical to SEQ ID NO: 1914
  hemagglutinin__InfluenzaA__ABV30558

SEQ ID NO: 1980 - protein, 565 aa, Artificial Sequence
  hemagglutinin__InfluenzaA__ABV30569
MKVKLLILLCTFTATYADTICIGYHANNSTDTVDTVLEKNVTVTHSVNLLEDNHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1981 - protein, 565 aa, Artificial Sequence; identical to SEQ ID NO: 1914
  hemagglutinin__InfluenzaA__ABV30580

SEQ ID NO: 1982 - protein, 565 aa, Artificial Sequence; identical to SEQ ID NO: 1910
  hemagglutinin__InfluenzaA__ABV30591

SEQ ID NO: 1983 - protein, 565 aa, Artificial Sequence; identical to SEQ ID NO: 1910
  hemagglutinin__InfluenzaA__ABV30602

SEQ ID NO: 1984 - protein, 565 aa, Artificial Sequence
  hemagglutinin__InfluenzaA__ABV30613
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMKNLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1985 - protein, 565 aa, Artificial Sequence; identical to SEQ ID NO: 1910
  hemagglutinin__InfluenzaA__ABV30624

SEQ ID NO: 1986 - protein, 566 aa, Artificial Sequence
  hemagglutinin__InfluenzaA__ABV30646
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTYNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1987 - protein, 566 aa, Artificial Sequence
  hemagglutinin__InfluenzaA__ABV30657
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQVFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1988 - protein, 566 aa, Artificial Sequence; identical to SEQ ID NO: 1987
  hemagglutinin__InfluenzaA__ABV45860

SEQ ID NO: 1989 - protein, 565 aa, Artificial Sequence; identical to SEQ ID NO: 1955
  hemagglutinin__InfluenzaA__ABV45871

SEQ ID NO: 1990 - protein, 565 aa, Artificial Sequence; identical to SEQ ID NO: 1914
  hemagglutinin__InfluenzaA__ABV45882

SEQ ID NO: 1991 - protein, 565 aa, Artificial Sequence; identical to SEQ ID NO: 1921
  hemagglutinin__InfluenzaA__ABV45893

SEQ ID NO: 1992 - protein, 566 aa, Artificial Sequence; identical to SEQ ID NO: 1729
  hemagglutinin__InfluenzaA__ABV45904

SEQ ID NO: 1993 - protein, 565 aa, Artificial Sequence; identical to SEQ ID NO: 1921
  hemagglutinin__InfluenzaA__ABV45926

SEQ ID NO: 1994 - protein, 565 aa, Artificial Sequence
  hemagglutinin__InfluenzaA__ABV45937
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFETNGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 1995 - protein, 565 aa, Artificial Sequence; identical to SEQ ID NO: 1947
  hemagglutinin__InfluenzaA__ABV45948

SEQ ID NO: 1996 - protein, 565 aa, Artificial Sequence; identical to SEQ ID NO: 1914
  hemagglutinin__InfluenzaA__ABV45959

SEQ ID NO: 1997 - protein, 566 aa, Artificial Sequence
  hemagglutinin__InfluenzaA__ABV45970
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDHASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 1998 - protein, 566 aa, Artificial Sequence
  hemagglutinin__InfluenzaA__ABV45981
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWIIWISFAISCFLLCVALLGFIMWACQKGNIRCNICI

SEQ ID NO: 1999 - protein, 565 aa, Artificial Sequence
  hemagglutinin__InfluenzaA__ABV82551
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGESSFYRNLLWLTEKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDKCDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2000 - protein, 566 aa, Artificial Sequence; identical to SEQ ID NO: 1928
  hemagglutinin__InfluenzaA__ABV82562

SEQ ID NO: 2001 - protein, 566 aa, Artificial Sequence; identical to SEQ ID NO: 1928
  hemagglutinin__InfluenzaA__ABW36168

SEQ ID NO: 2002 - protein, 565 aa, Artificial Sequence; identical to SEQ ID NO: 1914
  hemagglutinin__InfluenzaA__ABW36179

SEQ ID NO: 2003 - protein, 565 aa, Artificial Sequence; identical to SEQ ID NO: 1957
  hemagglutinin__InfluenzaA__ABW36190

SEQ ID NO: 2004 - protein, 565 aa, Artificial Sequence; identical to SEQ ID NO: 1914
  hemagglutinin__InfluenzaA__ABW36201

SEQ ID NO: 2005 - protein, 565 aa, Artificial Sequence
  hemagglutinin__InfluenzaA__ABW36212
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKENSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGLGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKGQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2006 - protein, 565 aa, Artificial Sequence; identical to SEQ ID NO: 1910
  hemagglutinin__InfluenzaA__ABW36223

SEQ ID NO: 2007 - protein, 565 aa, Artificial Sequence; identical to SEQ ID NO: 1910
  hemagglutinin__InfluenzaA__ABW36245

SEQ ID NO: 2008 - protein, 565 aa, Artificial Sequence; identical to SEQ ID NO: 1910
  hemagglutinin__InfluenzaA__ABW36267

SEQ ID NO: 2009 - protein, 565 aa, Artificial Sequence; identical to SEQ ID NO: 1914
  hemagglutinin__InfluenzaA__ABW36278

SEQ ID NO: 2010 - protein, 565 aa, Artificial Sequence
  hemagglutinin__InfluenzaA__ABW36289
MKLKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2011 - protein, 565 aa, Artificial Sequence; identical to SEQ ID NO: 1921
  hemagglutinin__InfluenzaA__ABW36300

SEQ ID NO: 2012 - protein, 566 aa, Artificial Sequence
  hemagglutinin__InfluenzaA__ABW36311
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAKRPKVRDQEGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDSHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2013 - protein, 566 aa, Artificial Sequence
  hemagglutinin__InfluenzaA__ABW38363
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELIVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2014 - protein, 565 aa, Artificial Sequence
  hemagglutinin__InfluenzaA__ABW39777
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKENSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGLGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2015 - protein, 565 aa, Artificial Sequence; identical to SEQ ID NO: 1914
  hemagglutinin__InfluenzaA__ABW39806

SEQ ID NO: 2016 - protein, 565 aa, Artificial Sequence; identical to SEQ ID NO: 1921
  hemagglutinin__InfluenzaA__ABW39817

SEQ ID NO: 2017 - protein, 565 aa, Artificial Sequence
  hemagglutinin__InfluenzaA__ABW39828
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 2018 - protein, 565 aa, Artificial Sequence
  hemagglutinin__InfluenzaA__ABW39839
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYSNNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVRNGTYDYPKYSEESKLNREKIDGVKLESMGVYQILAIYSTVASSLVLLVSLGAISFWMCSNGSLQCRICI

SEQ ID NO: 2019 - protein, 565 aa, Artificial Sequence
  hemagglutinin__InfluenzaA__ABW39850
MKVKLLVLLCTFTATNADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKGQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2020 - protein, 565 aa, Artificial Sequence; identical to SEQ ID NO: 1945
  hemagglutinin__InfluenzaA__ABW39861

SEQ ID NO: 2021 - protein, 566 aa, Artificial Sequence; identical to SEQ ID NO: 1928
  hemagglutinin__InfluenzaA__ABW39872

SEQ ID NO: 2022 - protein, 565 aa, Artificial Sequence
  hemagglutinin__InfluenzaA__ABW39883
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPHNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2023 - protein, 565 aa, Artificial Sequence; identical to SEQ ID NO: 1955
  hemagglutinin__InfluenzaA__ABW39894

SEQ ID NO: 2024 - protein, 565 aa, Artificial Sequence; identical to SEQ ID NO: 1910
  hemagglutinin__InfluenzaA__ABW39905

SEQ ID NO: 2025 - protein, 565 aa, Artificial Sequence; identical to SEQ ID NO: 1914
  hemagglutinin__InfluenzaA__ABW39927

SEQ ID NO: 2026 - protein, 566 aa, Artificial Sequence
  hemagglutinin__InfluenzaA__ABW39938
MKTIIALSYILCLVFAQKIPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDAYRDEALNNRFQIKGVELKSGYKDWILWISFAISCFLLCVALLGFIMWACQKGNIRCNICI

SEQ ID NO: 2027 - protein, 565 aa, Artificial Sequence; identical to SEQ ID NO: 1914
  hemagglutinin__InfluenzaA__ABW39949

SEQ ID NO: 2028 - protein, 565 aa, Artificial Sequence; identical to SEQ ID NO: 1955
  hemagglutinin__InfluenzaA__ABW39960

SEQ ID NO: 2029 - protein, 565 aa, Artificial Sequence; identical to SEQ ID NO: 1910
  hemagglutinin__InfluenzaA__ABW39982

SEQ ID NO: 2030 - protein, 565 aa, Artificial Sequence; identical to SEQ ID NO: 1930
  hemagglutinin__InfluenzaA__ABW39993

SEQ ID NO: 2031 - protein, 565 aa, Artificial Sequence; identical to SEQ ID NO: 1910
  hemagglutinin__InfluenzaA__ABW40004

SEQ ID NO: 2032 - protein, 565 aa, Artificial Sequence; identical to SEQ ID NO: 1956
  hemagglutinin__InfluenzaA__ABW40015

SEQ ID NO: 2033 - protein, 566 aa, Artificial Sequence; identical to SEQ ID NO: 1987
  hemagglutinin__InfluenzaA__ABW40026

SEQ ID NO: 2034 - protein, 565 aa, Artificial Sequence; identical to SEQ ID NO: 1910
  hemagglutinin__InfluenzaA__ABW40037

SEQ ID NO: 2035 - protein, 565 aa, Artificial Sequence
  hemagglutinin__InfluenzaA__ABW40048
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQKALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEKGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2036 - protein, 565 aa, Artificial Sequence; identical to SEQ ID NO: 1914
  hemagglutinin__InfluenzaA__ABW40059

SEQ ID NO: 2037 - protein, 565 aa, Artificial Sequence
  hemagglutinin__InfluenzaA__ABW40070
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFKRFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDSKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2038 - protein, 566 aa, Artificial Sequence; identical to SEQ ID NO: 1928
  hemagglutinin__InfluenzaA__ABW40081

SEQ ID NO: 2039 - protein, 565 aa, Artificial Sequence
  hemagglutinin__InfluenzaA__ABW40092
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFKRFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2040 - protein, 565 aa, Artificial Sequence; identical to SEQ ID NO: 1957
  hemagglutinin__InfluenzaA__ABW40103

SEQ ID NO: 2041 - protein, 565 aa, Artificial Sequence
  hemagglutinin__InfluenzaA__ABW40114
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSTSCSHNGKSSFYRNLLWLTGKNGLYPNLSKSYANNKEKEVLVLWGVHHPPNIGNQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2042 - protein, 565 aa, Artificial Sequence; identical to SEQ ID NO: 1910
  hemagglutinin__InfluenzaA__ABW40125

SEQ ID NO: 2043 - protein, 566 aa, Artificial Sequence; identical to SEQ ID NO: 1928
  hemagglutinin__InfluenzaA__ABW40136

SEQ ID NO: 2044 - protein, 565 aa, Artificial Sequence; identical to SEQ ID NO: 1945
  hemagglutinin__InfluenzaA__ABW40147

SEQ ID NO: 2045 - protein, 565 aa, Artificial Sequence; identical to SEQ ID NO: 1914
  hemagglutinin__InfluenzaA__ABW40158

SEQ ID NO: 2046 - protein, 565 aa, Artificial Sequence; identical to SEQ ID NO: 1914
  hemagglutinin__InfluenzaA__ABW40180

SEQ ID NO: 2047 - protein, 566 aa, Artificial Sequence; identical to SEQ ID NO: 1928
  hemagglutinin__InfluenzaA__ABW40191

SEQ ID NO: 2048 - protein, 565 aa, Artificial Sequence; identical to SEQ ID NO: 1930
  hemagglutinin__InfluenzaA__ABW40202

SEQ ID NO: 2049 - protein, 565 aa, Artificial Sequence; identical to SEQ ID NO: 1910
  hemagglutinin__InfluenzaA__ABW40213

SEQ ID NO: 2050 - protein, 565 aa, Artificial Sequence; identical to SEQ ID NO: 1910
  hemagglutinin__InfluenzaA__ABW40224

SEQ ID NO: 2051 - protein, 565 aa, Artificial Sequence; identical to SEQ ID NO: 1914
  hemagglutinin__InfluenzaA__ABW40235

SEQ ID NO: 2052 - protein, 566 aa, Artificial Sequence
  hemagglutinin__InfluenzaA__ABW40246
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQVFLYAQASGRITVSTKRSQQTVIPNIGSRPRVRNIPSRISIYWTIVKPGDILLINSTGNLIAPRGYFRIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2053 - protein, 565 aa, Artificial Sequence
  hemagglutinin__InfluenzaA__ABW40257
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2054 - protein, 566 aa, Artificial Sequence; identical to SEQ ID NO: 1987
  hemagglutinin__InfluenzaA__ABW40268

SEQ ID NO: 2055 - protein, 565 aa, Artificial Sequence
  hemagglutinin__InfluenzaA__ABW40312
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGRSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2056 - protein, 566 aa, Artificial Sequence; identical to SEQ ID NO: 1928
  hemagglutinin__InfluenzaA__ABW40323

SEQ ID NO: 2057 - protein, 565 aa, Artificial Sequence; identical to SEQ ID NO: 1956
  hemagglutinin__InfluenzaA__ABW40334

SEQ ID NO: 2058 - protein, 565 aa, Artificial Sequence; identical to SEQ ID NO: 1956
  hemagglutinin__InfluenzaA__ABW40345

SEQ ID NO: 2059 - protein, 565 aa, Artificial Sequence
  hemagglutinin__InfluenzaA__ABW40356
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVMWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2060 - protein, 565 aa, Artificial Sequence; identical to SEQ ID NO: 1914
  hemagglutinin__InfluenzaA__ABW40367

SEQ ID NO: 2061 - protein, 566 aa, Artificial Sequence; identical to SEQ ID NO: 1928
  hemagglutinin__InfluenzaA__ABW40378

SEQ ID NO: 2062 - protein, 565 aa, Artificial Sequence; identical to SEQ ID NO: 1914
  hemagglutinin__InfluenzaA__ABW40389

SEQ ID NO: 2063 - protein, 565 aa, Artificial Sequence; identical to SEQ ID NO: 1910
  hemagglutinin__InfluenzaA__ABW40400

SEQ ID NO: 2064 - protein, 565 aa, Artificial Sequence; identical to SEQ ID NO: 1910
  hemagglutinin__InfluenzaA__ABW40411

SEQ ID NO: 2065 - protein, 565 aa, Artificial Sequence; identical to SEQ ID NO: 1910
  hemagglutinin__InfluenzaA__ABW40422

SEQ ID NO: 2066 - protein, 565 aa, Artificial Sequence; identical to SEQ ID NO: 1956
  hemagglutinin__InfluenzaA__ABW40433

SEQ ID NO: 2067 - protein, 565 aa, Artificial Sequence; identical to SEQ ID NO: 1930
  hemagglutinin__InfluenzaA__ABW40444

SEQ ID NO: 2068 - protein, 565 aa, Artificial Sequence; identical to SEQ ID NO: 1947
  hemagglutinin__InfluenzaA__ABW40455

SEQ ID NO: 2069 - protein, 565 aa, Artificial Sequence; identical to SEQ ID NO: 1914
  hemagglutinin__InfluenzaA__ABW40466

SEQ ID NO: 2070 - protein, 565 aa, Artificial Sequence; identical to SEQ ID NO: 1914
  hemagglutinin__InfluenzaA__ABW40477

SEQ ID NO: 2071 - protein, 565 aa, Artificial Sequence; identical to SEQ ID NO: 1910
  hemagglutinin__InfluenzaA__ABW40488

SEQ ID NO: 2072 - protein, 565 aa, Artificial Sequence; identical to SEQ ID NO: 1914
  hemagglutinin__InfluenzaA__ABW40499

SEQ ID NO: 2073 - protein, 565 aa, Artificial Sequence; identical to SEQ ID NO: 1956
  hemagglutinin__InfluenzaA__ABW40510

SEQ ID NO: 2074 - protein, 565 aa, Artificial Sequence; identical to SEQ ID NO: 1910
  hemagglutinin__InfluenzaA__ABW40521

SEQ ID NO: 2075 - protein, 565 aa, Artificial Sequence; identical to SEQ ID NO: 1914
  hemagglutinin__InfluenzaA__ABW40532

SEQ ID NO: 2076 - protein, 565 aa, Artificial Sequence
  hemagglutinin__InfluenzaA__ABW40543
MKVKLLVLLCTFTATYADTICIGYHANNSTDTVDTVLEKNVTVTHSVNLLEDRHNGKLCLLKGIAPLQLGNCSVAGWILGNPECELLTSKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2077 - protein, 565 aa, Artificial Sequence; identical to SEQ ID NO: 2055
  hemagglutinin__InfluenzaA__ABW40554

SEQ ID NO: 2078 - protein, 565 aa, Artificial Sequence; identical to SEQ ID NO: 1914
  hemagglutinin__InfluenzaA__ABW40565

SEQ ID NO: 2079 - protein, 565 aa, Artificial Sequence
  hemagglutinin__InfluenzaA__ABW40576
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENTYVSVVSSHYSRRFTPEIAKRPKVRDQEGRINYYWTLLEPGDTIILEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2080 - protein, 566 aa, Artificial Sequence; identical to SEQ ID NO: 1987
  hemagglutinin__InfluenzaA__ABW40587

SEQ ID NO: 2081 - protein, 565 aa, Artificial Sequence; identical to SEQ ID NO: 1956
  hemagglutinin__InfluenzaA__ABW40598

SEQ ID NO: 2082 - protein, 565 aa, Artificial Sequence; identical to SEQ ID NO: 1930
  hemagglutinin__InfluenzaA__ABW40609

SEQ ID NO: 2083 - protein, 565 aa, Artificial Sequence; identical to SEQ ID NO: 1945
  hemagglutinin__InfluenzaA__ABW40620

SEQ ID NO: 2084 - protein, 566 aa, Artificial Sequence; identical to SEQ ID NO: 1987
  hemagglutinin__InfluenzaA__ABW40631

SEQ ID NO: 2085 - protein, 565 aa, Artificial Sequence; identical to SEQ ID NO: 1910
  hemagglutinin__InfluenzaA__ABW40642

SEQ ID NO: 2086 - protein, 566 aa, Artificial Sequence; identical to SEQ ID NO: 1987
  hemagglutinin__InfluenzaA__ABW40653

SEQ ID NO: 2087 - protein, 565 aa, Artificial Sequence; identical to SEQ ID NO: 1956
  hemagglutinin__InfluenzaA__ABW40664

SEQ ID NO: 2088 - protein, 565 aa, Artificial Sequence; identical to SEQ ID NO: 1930
  hemagglutinin__InfluenzaA__ABW40675

SEQ ID NO: 2089 - protein, 565 aa, Artificial Sequence; identical to SEQ ID NO: 2059
  hemagglutinin__InfluenzaA__ABW71294

SEQ ID NO: 2090 - protein, 565 aa, Artificial Sequence; identical to SEQ ID NO: 1956
  hemagglutinin__InfluenzaA__ABW71305

SEQ ID NO: 2091 - protein, 565 aa, Artificial Sequence
  hemagglutinin__InfluenzaA__ABW71316
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPRDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2092 - protein, 565 aa, Artificial Sequence; identical to SEQ ID NO: 1910
  hemagglutinin__InfluenzaA__ABW71327

SEQ ID NO: 2093 - protein, 565 aa, Artificial Sequence; identical to SEQ ID NO: 1914
  hemagglutinin__InfluenzaA__ABW71338

SEQ ID NO: 2094 - protein, 566 aa, Artificial Sequence; identical to SEQ ID NO: 1928
  hemagglutinin__InfluenzaA__ABW71349

SEQ ID NO: 2095 - protein, 565 aa, Artificial Sequence
  hemagglutinin__InfluenzaA__ABW71360
MKVKLLVLLCTFTATYADTICIGYHANNSTDTVDTVLEKNVTVTHSVNLLEDRHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSRSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCDDECMESVKNGTYDYPKYSEESKLNREKIDGVKLESMGVYQILAIYSTVASSLVLLVSLGAISFWMCSNGSLQCRICI

SEQ ID NO: 2096 - protein, 565 aa, Artificial Sequence; identical to SEQ ID NO: 1930
  hemagglutinin__InfluenzaA__ABW71371

SEQ ID NO: 2097 - protein, 565 aa, Artificial Sequence
  hemagglutinin__InfluenzaA__ABW71382
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWSNHTITGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2098 - protein, 565 aa, Artificial Sequence
  hemagglutinin__InfluenzaA__ABW71393
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFTDYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2099 - protein, 565 aa, Artificial Sequence; identical to SEQ ID NO: 2059
  hemagglutinin__InfluenzaA__ABW71404

SEQ ID NO: 2100 - protein, 565 aa, Artificial Sequence; identical to SEQ ID NO: 1947
  hemagglutinin__InfluenzaA__ABW71415

SEQ ID NO: 2101 - protein, 565 aa, Artificial Sequence
  hemagglutinin__InfluenzaA__ABW71426
MKAKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2102 - protein, 565 aa, Artificial Sequence
  hemagglutinin__InfluenzaA__ABW71448
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTIASSLVLLVSLGAISFWMCSNGSLQCRICI

SEQ ID NO: 2103 - protein, 565 aa, Artificial Sequence; identical to SEQ ID NO: 1930
  hemagglutinin__InfluenzaA__ABW71459

SEQ ID NO: 2104 - protein, 565 aa, Artificial Sequence; identical to SEQ ID NO: 1914
  hemagglutinin__InfluenzaA__ABW71470

SEQ ID NO: 2105 - protein, 568 aa, Artificial Sequence
  hemagglutinin__InfluenzaA__ABW74702
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSSSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECIESIRNGTYNYPQYSEEARLKREEISGVKLESIGTYQILSIYSTVASSLALAIMMAGLSLWMCSNGSLQCRICI

SEQ ID NO: 2106 - protein, 568 aa, Artificial Sequence
  hemagglutinin__InfluenzaA__ABW74703
MEKIVLLLAIVSLVKSDQICIGYHANNSTEQVDTIMEKNVTVTHAQDILEKTHNGKLCDLDGVKPLILKDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAVNFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNSLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 2107 - protein, 568 aa, Artificial Sequence
  hemagglutinin__InfluenzaA__ABW74705
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 2108 - protein, 568 aa, Artificial Sequence
  hemagglutinin__InfluenzaA__ABW74707
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKMATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 2109 - protein, 568 aa, Artificial Sequence
  hemagglutinin__InfluenzaA__ABW74708
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRSVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICI

SEQ ID NO: 2110 - protein, 568 aa, Artificial Sequence; identical to SEQ ID NO: 2107
  hemagglutinin__InfluenzaA__ABW74710

SEQ ID NO: 2111 - protein, 568 aa, Artificial Sequence; identical to SEQ ID NO: 2107
  hemagglutinin__InfluenzaA__ABW74711

SEQ ID NO: 2112 - protein, 568 aa, Artificial Sequence
  hemagglutinin__InfluenzaA__ABW74712
MEKIVLLLSIVSLVKSDQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNNEEEQTRLYQNPTTYISIGTSTLNQRLVPKIATRSKVNGQSGRMEFFWTILKPNDAINFESNGNFIAPEYAYKIVKKGDSAIMKSELEYSNCNTKCQTPMGAINSSMPFHNIHPLTIGECPKYVKSSRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMIAGLSLWMCSNGSLQCRICI

SEQ ID NO: 2113 - protein, 566 aa, Artificial Sequence
  hemagglutinin__InfluenzaA__ABW80976
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISIYAQASGRVTVSTKRSQQTVIPNIGSRPWVRGVSSGISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 2114 - protein, 566 aa, Artificial Sequence
  hemagglutinin__InfluenzaA__ABW80977
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQINLYAQASGRITVSTKRSQQTVIPNIGSRPRVRDVPSRISIYWTIVKPGDILLISSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2115 - protein, 565 aa, Artificial Sequence
  hemagglutinin__InfluenzaA__ABW80979
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2116 - protein, 566 aa, Artificial Sequence
  hemagglutinin__InfluenzaA__ABW81505
MKAKLLVLLCTFTATYADTICIGYHANNSTDTVDTVLEKNVTVTHSVNLLEDSHNGKLCRLKGTAPLQLGNCSIAGWILGNPECESLFSKESWSYIAETPNPKNGTCYPGYFADYEELREQLSSVSSFERFEIFPKDSSWPNHTVTKGVTASCSHNGKSSFYKNLLWLTEKNGLYPNLSKSYVNKKGKEVLVLWGVHHPSNMGDQRAIYHKENAYVSVLSSHYSRRFTPEIAKRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 2117 - protein, 565 aa, Artificial Sequence
  hemagglutinin__InfluenzaA__ABW81506
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGIYQILAIYSTVASSLVLLVSLGAISFWMCSNGSLQCRICI

SEQ ID NO: 2118 - protein, 566 aa, Artificial Sequence
  hemagglutinin__InfluenzaA__ABW81507
MKAKLLVLLCTFTATYADTICIGYHANNSTDTVDTVLEKNVTVTHSVNLLEDSHNGKLCRLKGTVPLQLGNCSIAGWILGNPECESLFSKESWSYIAETPNPKNGTCYPGYFADYEELREQLSSVSSFERFEIFPKDSSWPNHTVTKGVTASCSHNGKSSFYKNLLWLTEKNGLYPNLSKSYVNKKGKEVLVLWGVHHPSNMGDQRAIYHKENAYVSVLSSHYSRRFTPEIAKRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 2119 - protein, 565 aa, Artificial Sequence
  hemagglutinin__InfluenzaA__ABW81508
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTRKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2120 - protein, 566 aa, Artificial Sequence; identical to SEQ ID NO: 2116
  hemagglutinin__InfluenzaA__ABW81509

SEQ ID NO: 2121 - protein, 565 aa, Artificial Sequence
  hemagglutinin__InfluenzaA__ABW81511
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDSIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2122 - protein, 565 aa, Artificial Sequence; identical to SEQ ID NO: 296
  hemagglutinin__InfluenzaA__ABW81512

SEQ ID NO: 2123 - protein, 565 aa, Artificial Sequence; identical to SEQ ID NO: 1385
  hemagglutinin__InfluenzaA__ABW81513

SEQ ID NO: 2124 - protein, 565 aa, Artificial Sequence
  hemagglutinin__InfluenzaA__ABW81514
MKVKLLVLLCTFTATYADTICISYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2125 - protein, 565 aa, Artificial Sequence; identical to SEQ ID NO: 1385
  hemagglutinin__InfluenzaA__ABW81515

SEQ ID NO: 2126 - protein, 565 aa, Artificial Sequence; identical to SEQ ID NO: 1385
  hemagglutinin__InfluenzaA__ABW81516

SEQ ID NO: 2127 - protein, 565 aa, Artificial Sequence
  hemagglutinin__InfluenzaA__ABW81517
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSISSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2128 - protein, 565 aa, Artificial Sequence
  hemagglutinin__InfluenzaA__ABW81518
MKVKLLVLLCTYTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2129 - protein, 565 aa, Artificial Sequence
  hemagglutinin__InfluenzaA__ABW81519
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAHVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2130 - protein, 565 aa, Artificial Sequence
  hemagglutinin__InfluenzaA__ABW81520
MKVKLLVLLCTFTATYADTICIGYHANNSTDTVDTVLEKNVTVTHSVNLLEDSHNGKLCLLKGIAPLQLGSCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2131 - protein, 565 aa, Artificial Sequence
  hemagglutinin__InfluenzaA__ABW81521
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIISSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2132 - protein, 565 aa, Artificial Sequence; identical to SEQ ID NO: 1385
  hemagglutinin__InfluenzaA__ABW81522

SEQ ID NO: 2133 - protein, 565 aa, Artificial Sequence; identical to SEQ ID NO: 1385
  hemagglutinin__InfluenzaA__ABW81523

SEQ ID NO: 2134 - protein, 565 aa, Artificial Sequence
  hemagglutinin__InfluenzaA__ABW81524
MKVKLLVLLCTFTATYADTICIGYHANNSTDTIDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2135 - protein, 565 aa, Artificial Sequence
  hemagglutinin__InfluenzaA__ABW81526
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDLHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2136 - protein, 565 aa, Artificial Sequence
  hemagglutinin__InfluenzaA__ABW81527
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRNQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2137 - protein, 565 aa, Artificial Sequence
  hemagglutinin__InfluenzaA__ABW81528
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGHFADYEELREQLSSVSSFERFEIFPKESSWPNHTVTGVSASCSHNGKSSFYRNLLWLTGKNGLYPNLSKSYANNKEKEVLVLWGIHHPPNIGDQRALYHTENAYVSVVSSHYSRRFTPEIAKRPKVRDQEGRINYYWTLLEPRDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2138 - protein, 565 aa, Artificial Sequence
  hemagglutinin__InfluenzaA__ABW81529
MKVKLLILLCTFTATYADTICIGYHANNSTDTVDTVLEKNVTVTHSVNLLEDSHNGKLCLLKGIAPLQLGNCSVAGWILGNPECELLISRESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLILWGVHHPPNIRDQMTLYHTENAYVSVVSSHYSRRFTPEITKRPKVRDQEGRINYYWTLLEPGDTIIFEANGNLIAPWYAFALSRGFGSGIITSNAPMDECDAKCQTPKGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2139 - protein, 565 aa, Artificial Sequence
  hemagglutinin__InfluenzaA__ABW81530
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINRITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 2140 - protein, 565 aa, Artificial Sequence; identical to SEQ ID NO: 326
  hemagglutinin__InfluenzaA__ABW81531

SEQ ID NO: 2141 - protein, 565 aa, Artificial Sequence
  hemagglutinin__InfluenzaA__ABW81532
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPWYFADYEELREQLSSVSSFERFEIFPKESSWPNHTVTGVSASCSHNGKSSFYRNLLWLTGKNGLYPNLSKSYANNKEKEVLILWGVHHPPNIGNQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 2142 - protein, 565 aa, Artificial Sequence; identical to SEQ ID NO: 1956
  hemagglutinin__InfluenzaA__ABW86321

SEQ ID NO: 2143 - protein, 565 aa, Artificial Sequence; identical to SEQ ID NO: 1921
  hemagglutinin__InfluenzaA__ABW86332

SEQ ID NO: 2144 - protein, 565 aa, Artificial Sequence; identical to SEQ ID NO: 1910
  hemagglutinin__InfluenzaA__ABW86343

SEQ ID NO: 2145 - protein, 565 aa, Artificial Sequence; identical to SEQ ID NO: 1914
  hemagglutinin__InfluenzaA__ABW86354

SEQ ID NO: 2146 - protein, 565 aa, Artificial Sequence; identical to SEQ ID NO: 1914
  hemagglutinin__InfluenzaA__ABW86365

SEQ ID NO: 2147 - protein, 565 aa, Artificial Sequence; identical to SEQ ID NO: 1930
  hemagglutinin__InfluenzaA__ABW86376

SEQ ID NO: 2148 - protein, 565 aa, Artificial Sequence; identical to SEQ ID NO: 1914
  hemagglutinin__InfluenzaA__ABW86387

SEQ ID NO: 2149 - protein, 565 aa, Artificial Sequence; identical to SEQ ID NO: 1910
  hemagglutinin__InfluenzaA__ABW86409

SEQ ID NO: 2150 - protein, 565 aa, Artificial Sequence; identical to SEQ ID NO: 1910
  hemagglutinin__InfluenzaA__ABW86431

SEQ ID NO: 2151 - protein, 565 aa, Artificial Sequence; identical to SEQ ID NO: 1914
  hemagglutinin__InfluenzaA__ABW86442

SEQ ID NO: 2152 - protein, 565 aa, Artificial Sequence; identical to SEQ ID NO: 1930
  hemagglutinin__InfluenzaA__ABW86453

SEQ ID NO: 2153 - protein, 565 aa, Artificial Sequence; identical to SEQ ID NO: 1914
  hemagglutinin__InfluenzaA__ABW86464

SEQ ID NO: 2154 - protein, 565 aa, Artificial Sequence; identical to SEQ ID NO: 1930
  hemagglutinin__InfluenzaA__ABW86475

SEQ ID NO: 2155 - protein, 565 aa, Artificial Sequence; identical to SEQ ID NO: 1910
  hemagglutinin__InfluenzaA__ABW86486

SEQ ID NO: 2156 - protein, 565 aa, Artificial Sequence; identical to SEQ ID NO: 1956
  hemagglutinin__InfluenzaA__ABW86497

SEQ ID NO: 2157 - protein, 565 aa, Artificial Sequence; identical to SEQ ID NO: 1914
  hemagglutinin__InfluenzaA__ABW86508

SEQ ID NO: 2158 - protein, 565 aa, Artificial Sequence
  hemagglutinin__InfluenzaA__ABW86519
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRNQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2159 - protein, 565 aa, Artificial Sequence; identical to SEQ ID NO: 1910
  hemagglutinin__InfluenzaA__ABW86530

SEQ ID NO: 2160 - protein, 565 aa, Artificial Sequence
  hemagglutinin__InfluenzaA__ABW86541
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWLNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2161 - protein, 565 aa, Artificial Sequence; identical to SEQ ID NO: 1910
  hemagglutinin__InfluenzaA__ABW86552

SEQ ID NO: 2162 - protein, 566 aa, Artificial Sequence
  hemagglutinin__InfluenzaA__ABW86563
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGHKDWILWISFAISCFLLCVALLGFIMWACQKGNIRCNICI

SEQ ID NO: 2163 - protein, 565 aa, Artificial Sequence; identical to SEQ ID NO: 1947
  hemagglutinin__InfluenzaA__ABW86606

SEQ ID NO: 2164 - protein, 566 aa, Artificial Sequence; identical to SEQ ID NO: 921
  hemagglutinin__InfluenzaA__ABW91185

SEQ ID NO: 2165 - protein, 566 aa, Artificial Sequence
  hemagglutinin__InfluenzaA__ABW91196
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2166 - protein, 566 aa, Artificial Sequence; identical to SEQ ID NO: 2165
  hemagglutinin__InfluenzaA__ABW91207

SEQ ID NO: 2167 - protein, 565 aa, Artificial Sequence; identical to SEQ ID NO: 1910
  hemagglutinin__InfluenzaA__ABW91218

SEQ ID NO: 2168 - protein, 566 aa, Artificial Sequence; identical to SEQ ID NO: 1928
  hemagglutinin__InfluenzaA__ABW91240

SEQ ID NO: 2169 - protein, 566 aa, Artificial Sequence
  hemagglutinin__InfluenzaA__ABW91251
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKSGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2170 - protein, 566 aa, Artificial Sequence; identical to SEQ ID NO: 1928
  hemagglutinin__InfluenzaA__ABW91262

SEQ ID NO: 2171 - protein, 565 aa, Artificial Sequence; identical to SEQ ID NO: 1945
  hemagglutinin__InfluenzaA__ABW91273

SEQ ID NO: 2172 - protein, 565 aa, Artificial Sequence
  hemagglutinin__InfluenzaA__ABW91284
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNASMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2173 - protein, 565 aa, Artificial Sequence; identical to SEQ ID NO: 1945
  hemagglutinin__InfluenzaA__ABW91295

SEQ ID NO: 2174 - protein, 565 aa, Artificial Sequence; identical to SEQ ID NO: 1914
  hemagglutinin__InfluenzaA__ABW91306

SEQ ID NO: 2175 - protein, 565 aa, Artificial Sequence; identical to SEQ ID NO: 1914
  hemagglutinin__InfluenzaA__ABW91317

SEQ ID NO: 2176 - protein, 565 aa, Artificial Sequence
  hemagglutinin__InfluenzaA__ABW91328
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVRSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2177 - protein, 565 aa, Artificial Sequence; identical to SEQ ID NO: 1914
  hemagglutinin__InfluenzaA__ABW91339

SEQ ID NO: 2178 - protein, 565 aa, Artificial Sequence; identical to SEQ ID NO: 1914
  hemagglutinin__InfluenzaA__ABW91350

SEQ ID NO: 2179 - protein, 565 aa, Artificial Sequence
  hemagglutinin__InfluenzaA__ABW91361
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGESSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDKCDAKCQTPQGAINSSLPFQNVHPVTIGECPKYVRSTKLRMVTGLRNIPSIQTRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2180 - protein, 565 aa, Artificial Sequence; identical to SEQ ID NO: 1914
  hemagglutinin__InfluenzaA__ABW91372

SEQ ID NO: 2181 - protein, 565 aa, Artificial Sequence; identical to SEQ ID NO: 1947
  hemagglutinin__InfluenzaA__ABW91383

SEQ ID NO: 2182 - protein, 566 aa, Artificial Sequence; identical to SEQ ID NO: 1987
  hemagglutinin__InfluenzaA__ABW91394

SEQ ID NO: 2183 - protein, 565 aa, Artificial Sequence; identical to SEQ ID NO: 1956
  hemagglutinin__InfluenzaA__ABW91405

SEQ ID NO: 2184 - protein, 565 aa, Artificial Sequence
  hemagglutinin__InfluenzaA__ABW91416
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQKALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2185 - protein, 565 aa, Artificial Sequence; identical to SEQ ID NO: 2059
  hemagglutinin__InfluenzaA__ABW91427

SEQ ID NO: 2186 - protein, 566 aa, Artificial Sequence; identical to SEQ ID NO: 1928
  hemagglutinin__InfluenzaA__ABW91438

SEQ ID NO: 2187 - protein, 565 aa, Artificial Sequence; identical to SEQ ID NO: 1956
  hemagglutinin__InfluenzaA__ABW91449

SEQ ID NO: 2188 - protein, 565 aa, Artificial Sequence; identical to SEQ ID NO: 1956
  hemagglutinin__InfluenzaA__ABW91460

SEQ ID NO: 2189 - protein, 565 aa, Artificial Sequence
  hemagglutinin__InfluenzaA__ABW91471
MKVKLLVLLCTFTATYADTICIGYHANNSTDTVDTVLEKNVTVTHSVNLLEDSHNGKLCLLKGVAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2190 - protein, 565 aa, Artificial Sequence
  hemagglutinin__InfluenzaA__ABW91482
MKVKLLVLLCTFTATYADTICIGYHANNSTDTVDTVLEKNVTVTHSVNLLEDRHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGRSSFYRNLLWLTGKNGLYPNLSRSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2191 - protein, 565 aa, Artificial Sequence
  hemagglutinin__InfluenzaA__ABW91493
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2192 - protein, 565 aa, Artificial Sequence; identical to SEQ ID NO: 1930
  hemagglutinin__InfluenzaA__ABW91504

SEQ ID NO: 2193 - protein, 565 aa, Artificial Sequence
  hemagglutinin__InfluenzaA__ABW91515
MKVKLLVLLCTFTATYADTICIGYHANNSTDTVDTVLEKNVTVTHSVNLLEDRHNGKLCLLKGIAPLQLGNCSVAGWILGNPECELLISKESWSYVVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2194 - protein, 565 aa, Artificial Sequence
  hemagglutinin__InfluenzaA__ABW91526
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVREQEGRINYYWTLLEPGDTIIFEANGNLIAPRFAFALSRGFGSGIITSNAPMDECDAKCQTPQGAINSSLPFQNVHPVTIGECPKYVRSTRLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2195 - protein, 565 aa, Artificial Sequence; identical to SEQ ID NO: 1914
  hemagglutinin__InfluenzaA__ABW91537

SEQ ID NO: 2196 - protein, 566 aa, Artificial Sequence; identical to SEQ ID NO: 1987
  hemagglutinin__InfluenzaA__ABW91548

SEQ ID NO: 2197 - protein, 565 aa, Artificial Sequence
  hemagglutinin__InfluenzaA__ABW91559
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLYREKIDGVKLESMGVYQILAIYSTVASSLVLLVSLGAISFWMCSNGSLQCRICI

SEQ ID NO: 2198 - protein, 565 aa, Artificial Sequence; identical to SEQ ID NO: 2055
  hemagglutinin__InfluenzaA__ABW91570

SEQ ID NO: 2199 - protein, 565 aa, Artificial Sequence; identical to SEQ ID NO: 1930
  hemagglutinin__InfluenzaA__ABW91581

SEQ ID NO: 2200 - protein, 565 aa, Artificial Sequence; identical to SEQ ID NO: 1910
  hemagglutinin__InfluenzaA__ABW91592

SEQ ID NO: 2201 - protein, 565 aa, Artificial Sequence; identical to SEQ ID NO: 1956
  hemagglutinin__InfluenzaA__ABW91603

SEQ ID NO: 2202 - protein, 565 aa, Artificial Sequence
  hemagglutinin__InfluenzaA__ABW91614
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPSPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIISSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2203 - protein, 565 aa, Artificial Sequence; identical to SEQ ID NO: 1945
  hemagglutinin__InfluenzaA__ABW91625

SEQ ID NO: 2204 - protein, 565 aa, Artificial Sequence; identical to SEQ ID NO: 1914
  hemagglutinin__InfluenzaA__ABW91636

SEQ ID NO: 2205 - protein, 566 aa, Artificial Sequence; identical to SEQ ID NO: 1987
  hemagglutinin__InfluenzaA__ABW91647

SEQ ID NO: 2206 - protein, 568 aa, Artificial Sequence
  hemagglutinin__InfluenzaA__ABX10515
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEVSLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLKDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 2207 - protein, 566 aa, Artificial Sequence; identical to SEQ ID NO: 1856
  hemagglutinin__InfluenzaA__ABX10525

SEQ ID NO: 2208 - protein, 565 aa, Artificial Sequence; identical to SEQ ID NO: 1914
  hemagglutinin__InfluenzaA__ABX58239

SEQ ID NO: 2209 - protein, 565 aa, Artificial Sequence; identical to SEQ ID NO: 2014
  hemagglutinin__InfluenzaA__ABX58250

SEQ ID NO: 2210 - protein, 565 aa, Artificial Sequence
  hemagglutinin__InfluenzaA__ABX58261
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWSLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2211 - protein, 565 aa, Artificial Sequence
  hemagglutinin__InfluenzaA__ABX58272
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKKSSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2212 - protein, 565 aa, Artificial Sequence; identical to SEQ ID NO: 1914
  hemagglutinin__InfluenzaA__ABX58283

SEQ ID NO: 2213 - protein, 565 aa, Artificial Sequence; identical to SEQ ID NO: 2055
  hemagglutinin__InfluenzaA__ABX58294

SEQ ID NO: 2214 - protein, 565 aa, Artificial Sequence; identical to SEQ ID NO: 1910
  hemagglutinin__InfluenzaA__ABX58316

SEQ ID NO: 2215 - protein, 565 aa, Artificial Sequence; identical to SEQ ID NO: 2059
  hemagglutinin__InfluenzaA__ABX58327

SEQ ID NO: 2216 - protein, 565 aa, Artificial Sequence; identical to SEQ ID NO: 1910
  hemagglutinin__InfluenzaA__ABX58338

SEQ ID NO: 2217 - protein, 565 aa, Artificial Sequence
  hemagglutinin__InfluenzaA__ABX58360
MKVKLLVLLCTFTATYADTICIGYHANNSTDTVDTVLEKNVTVTHSVNLLEDSHNGKLCLLKGIAPIQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDGCMESVKNGTYDYPKYSEESKLNREKIDGVKLESMGVYQILAIYSTVASSLVLLVSLGAISFWMCSNGSLQCRICI

SEQ ID NO: 2218 - protein, 565 aa, Artificial Sequence; identical to SEQ ID NO: 1914
  hemagglutinin__InfluenzaA__ABX58371

SEQ ID NO: 2219 - protein, 565 aa, Artificial Sequence; identical to SEQ ID NO: 1914
  hemagglutinin__InfluenzaA__ABX58382

SEQ ID NO: 2220 - protein, 565 aa, Artificial Sequence; identical to SEQ ID NO: 2055
  hemagglutinin__InfluenzaA__ABX58393

SEQ ID NO: 2221 - protein, 565 aa, Artificial Sequence; identical to SEQ ID NO: 1914
  hemagglutinin__InfluenzaA__ABX58404

SEQ ID NO: 2222 - protein, 565 aa, Artificial Sequence
  hemagglutinin__InfluenzaA__ABX58415
MKVKLLVLLCTFTATYADTICIGYHANNSTDTVDTVLEKNVTVTHSVNLLEDRHNGKLCLLKGIAPLQLGNCSVAGWILGNPECELLISKKSWSYIVETPNPENGTCYPGYFADYEELREQLSSVSSFERFEIFPKESSWPNHTVTGVSASCSHNGKSSFYRNLLWLTGKNGLYPNLSRSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2223 - protein, 565 aa, Artificial Sequence; identical to SEQ ID NO: 1914
  hemagglutinin__InfluenzaA__ABX58426

SEQ ID NO: 2224 - protein, 565 aa, Artificial Sequence; identical to SEQ ID NO: 1914
  hemagglutinin__InfluenzaA__ABX58437

SEQ ID NO: 2225 - protein, 565 aa, Artificial Sequence; identical to SEQ ID NO: 1910
  hemagglutinin__InfluenzaA__ABX58448

SEQ ID NO: 2226 - protein, 565 aa, Artificial Sequence; identical to SEQ ID NO: 1956
  hemagglutinin__InfluenzaA__ABX58459

SEQ ID NO: 2227 - protein, 565 aa, Artificial Sequence; identical to SEQ ID NO: 2055
  hemagglutinin__InfluenzaA__ABX58470

SEQ ID NO: 2228 - protein, 565 aa, Artificial Sequence; identical to SEQ ID NO: 1956
  hemagglutinin__InfluenzaA__ABX58481

SEQ ID NO: 2229 - protein, 565 aa, Artificial Sequence; identical to SEQ ID NO: 1914
  hemagglutinin__InfluenzaA__ABX58492

SEQ ID NO: 2230 - protein, 565 aa, Artificial Sequence; identical to SEQ ID NO: 1930
  hemagglutinin__InfluenzaA__ABX58503

SEQ ID NO: 2231 - protein, 565 aa, Artificial Sequence; identical to SEQ ID NO: 1956
  hemagglutinin__InfluenzaA__ABX58525

SEQ ID NO: 2232 - protein, 565 aa, Artificial Sequence
  hemagglutinin__InfluenzaA__ABX58536
MKVKLLVLLCTFTATYADTICIGYHANNSTDTVDTVLEKNVTVTHSVNLLEDRHNGKLCLLKGIAPLQLGNCSVAGWILGNPECELLISKEPWSYIVETPNPENGTCYPGYFADYEELREQLSSVSSFERFEIFPKESSWPNHTVTGVSASCSHNGKSSFYRNLLWLTGKNGLYPNLSRSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2233 - protein, 565 aa, Artificial Sequence
  hemagglutinin__InfluenzaA__ABX58547
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQTRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2234 - protein, 565 aa, Artificial Sequence
  hemagglutinin__InfluenzaA__ABX58558
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGRSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDKCDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2235 - protein, 565 aa, Artificial Sequence
  hemagglutinin__InfluenzaA__ABX58569
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTATGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2236 - protein, 565 aa, Artificial Sequence; identical to SEQ ID NO: 1910
  hemagglutinin__InfluenzaA__ABX58580

SEQ ID NO: 2237 - protein, 565 aa, Artificial Sequence; identical to SEQ ID NO: 1914
  hemagglutinin__InfluenzaA__ABX58591

SEQ ID NO: 2238 - protein, 565 aa, Artificial Sequence
  hemagglutinin__InfluenzaA__ABX58602
MKVKLLVLLCTFTATYADTICIGYHANNSTDTVDTVLEKNVTVTHSVNLLEDSHNGKLCLLEGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPRDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2239 - protein, 565 aa, Artificial Sequence; identical to SEQ ID NO: 1947
  hemagglutinin__InfluenzaA__ABX58613

SEQ ID NO: 2240 - protein, 565 aa, Artificial Sequence; identical to SEQ ID NO: 1914
  hemagglutinin__InfluenzaA__ABX58624

SEQ ID NO: 2241 - protein, 565 aa, Artificial Sequence
  hemagglutinin__InfluenzaA__ABX58635
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGRSSFYRNLLWLTGKNGLYPSLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2242 - protein, 565 aa, Artificial Sequence; identical to SEQ ID NO: 1910
  hemagglutinin__InfluenzaA__ABX58679

SEQ ID NO: 2243 - protein, 565 aa, Artificial Sequence; identical to SEQ ID NO: 1956
  hemagglutinin__InfluenzaA__ABX58701

SEQ ID NO: 2244 - protein, 565 aa, Artificial Sequence; identical to SEQ ID NO: 2014
  hemagglutinin__InfluenzaA__ABX58712

SEQ ID NO: 2245 - protein, 567 aa, Artificial Sequence
  hemagglutinin__InfluenzaA__ABY19417
MEKIVLLLAIISLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGVPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFKFYHKCDNECMESVRNGTYDYPQYSEEARLKREEISGVKLESIGTYQILSIYSTVASSLALAIMVAGLSLWMCSNGSLQCRIRI

SEQ ID NO: 2246 - protein, 567 aa, Artificial Sequence
  hemagglutinin__InfluenzaA__ABY19418
MEKIVLLLAIISLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGDFNDYEELKHLLSRINHFEKIQIIPKSSWSDHEASSGVSSACPYQGVPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGFHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 2247 - protein, 567 aa, Artificial Sequence
  hemagglutinin__InfluenzaA__ABY19419
MEKIVLLLAIISLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGVPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 2248 - protein, 565 aa, Artificial Sequence; identical to SEQ ID NO: 2055
  hemagglutinin__InfluenzaA__ABY51017

SEQ ID NO: 2249 - protein, 566 aa, Artificial Sequence; identical to SEQ ID NO: 1928
  hemagglutinin__InfluenzaA__ABY51028

SEQ ID NO: 2250 - protein, 565 aa, Artificial Sequence
  hemagglutinin__InfluenzaA__ABY51039
MKVKLLVLLCTFTATNADTICIGYHANNSTDTVDTVLEKNVTVTHSVNLLENSHNGKLCLLKGIAPLQLGNCSVAGWILGNPECELLISKESWSYIVETPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKGQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2251 - protein, 565 aa, Artificial Sequence
  hemagglutinin__InfluenzaA__ABY51050
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDSKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2252 - protein, 565 aa, Artificial Sequence; identical to SEQ ID NO: 2014
  hemagglutinin__InfluenzaA__ABY51061

SEQ ID NO: 2253 - protein, 565 aa, Artificial Sequence
  hemagglutinin__InfluenzaA__ABY51072
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKAFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2254 - protein, 565 aa, Artificial Sequence; identical to SEQ ID NO: 1956
  hemagglutinin__InfluenzaA__ABY51083

SEQ ID NO: 2255 - protein, 565 aa, Artificial Sequence; identical to SEQ ID NO: 1914
  hemagglutinin__InfluenzaA__ABY51094

SEQ ID NO: 2256 - protein, 565 aa, Artificial Sequence; identical to SEQ ID NO: 2055
  hemagglutinin__InfluenzaA__ABY51105

SEQ ID NO: 2257 - protein, 565 aa, Artificial Sequence; identical to SEQ ID NO: 1914
  hemagglutinin__InfluenzaA__ABY51116

SEQ ID NO: 2258 - protein, 566 aa, Artificial Sequence
  hemagglutinin__InfluenzaA__ABY51127
MKTIIALSYILCMVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQVFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2259 - protein, 565 aa, Artificial Sequence
  hemagglutinin__InfluenzaA__ABY51138
MKVKLLVLLCTFTATYADTICIGYHANNSTDTVDTVLEKNVTVTHSVNLLEDRHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSRSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKIQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2260 - protein, 565 aa, Artificial Sequence; identical to SEQ ID NO: 1914
  hemagglutinin__InfluenzaA__ABY51149

SEQ ID NO: 2261 - protein, 565 aa, Artificial Sequence
  hemagglutinin__InfluenzaA__ABY51160
MKVKLLVLLCTFTATYADTICIGYHANNSTDTVDTVLEKNVTVTHSVNLLEDRHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDKCDAKCQTPQGAINSSLPFQNVHPVTIGECPKYVRSAKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2262 - protein, 565 aa, Artificial Sequence
  hemagglutinin__InfluenzaA__ABY51171
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYQKYSEESKLNREKIDGVKLESMGVYQILAIYSTVASSLVLLVSLGAISFWMCSNGSLQCRICI

SEQ ID NO: 2263 - protein, 565 aa, Artificial Sequence; identical to SEQ ID NO: 1910
  hemagglutinin__InfluenzaA__ABY51182

SEQ ID NO: 2264 - protein, 565 aa, Artificial Sequence; identical to SEQ ID NO: 1930
  hemagglutinin__InfluenzaA__ABY51193

SEQ ID NO: 2265 - protein, 565 aa, Artificial Sequence; identical to SEQ ID NO: 1914
  hemagglutinin__InfluenzaA__ABY51237

SEQ ID NO: 2266 - protein, 565 aa, Artificial Sequence; identical to SEQ ID NO: 1930
  hemagglutinin__InfluenzaA__ABY51248

SEQ ID NO: 2267 - protein, 565 aa, Artificial Sequence; identical to SEQ ID NO: 1910
  hemagglutinin__InfluenzaA__ABY51259

SEQ ID NO: 2268 - protein, 566 aa, Artificial Sequence; identical to SEQ ID NO: 1987
  hemagglutinin__InfluenzaA__ABY51270

SEQ ID NO: 2269 - protein, 568 aa, Artificial Sequence
  hemagglutinin__InfluenzaA__ABY76282
MEKIVLLLAIVSLVKSDQICIGYHANNSTEHVDTIMEKNVTVTHAQDILEKAHNGRLCDLDGVKPLILRDCSVAGWLLGNPMCDEFLNVPEWSYIVEKNNPANDLCYPGNFNDYEELKHLLSRINHFEKIQIIPKSSWSDHEASSGVSSACPYQGRSSFFRNVVWLIKKNDAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 2270 - protein, 566 aa, Artificial Sequence
  hemagglutinin__InfluenzaA__ABY81349
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTAACSHKGKSSFYRNLLWLTEKNGSYPNLSKSYVNNKEKEVLVLWGVHHPSNIKDQKTIYQKENAYVSVVSSNYNRRFTPEIAKRPKVRDQEGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEVGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2271 - protein, 566 aa, Artificial Sequence; identical to SEQ ID NO: 1928
  hemagglutinin__InfluenzaA__ABY81371

SEQ ID NO: 2272 - protein, 565 aa, Artificial Sequence; identical to SEQ ID NO: 1914
  hemagglutinin__InfluenzaA__ABY81382

SEQ ID NO: 2273 - protein, 565 aa, Artificial Sequence; identical to SEQ ID NO: 1956
  hemagglutinin__InfluenzaA__ABY81393

SEQ ID NO: 2274 - protein, 565 aa, Artificial Sequence
  hemagglutinin__InfluenzaA__ABY81415
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPSPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2275 - protein, 566 aa, Artificial Sequence; identical to SEQ ID NO: 1928
  hemagglutinin__InfluenzaA__ACA24502

SEQ ID NO: 2276 - protein, 565 aa, Artificial Sequence
  hemagglutinin__InfluenzaA__ACA24513
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLNSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPRDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2277 - protein, 565 aa, Artificial Sequence; identical to SEQ ID NO: 1914
  hemagglutinin__InfluenzaA__ACA24524

SEQ ID NO: 2278 - protein, 566 aa, Artificial Sequence
  hemagglutinin__InfluenzaA__ACA24689
MKTIIALSYILCLVFAQKLPGIDNSTATLCLGHHAVPNGTIVKTITNDQIEVTNATELVQNSSTGGICDSPHQIIDGENCTLIDALLGDPQCDGFQNKKWDLFVERSKAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHYVYRDEALNNRFQIKGIELKSGYKDWILWISFAISCFLLCVALLGFIMWACQKGNIRCNICI

SEQ ID NO: 2279 - protein, 566 aa, Artificial Sequence
  hemagglutinin__InfluenzaA__ACA24700
MKTIIALSYILCLVFAQKLPGIDNSTATLCLGHHAVPNGTIVKTITNDQIEVTNATELVQNSSTGGICDSPHQILDGENCTLIDALLGDPQCDGFQNKKWDLFVERSQAYSNCYPYDVPDYASLRSLVASSGTLEFNNESFNWTGVTQNGTSSACKRGSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2280 - protein, 565 aa, Artificial Sequence
  hemagglutinin__InfluenzaA__ACA28846
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGIQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2281 - protein, 566 aa, Artificial Sequence
  hemagglutinin__InfluenzaA__ACA33749
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSSCIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2282 - protein, 565 aa, Artificial Sequence; identical to SEQ ID NO: 1910
  hemagglutinin__InfluenzaA__ACA96519

SEQ ID NO: 2283 - protein, 552 aa, Artificial Sequence
  hemagglutinin__InfluenzaA__ACC55270
MNTQILAFIACVLTGVKGDKICLGHHAVANGTKVNTLTERGIEVVNATETVETTNIKKICTQGKRPTDLGQCGLLGTLIGPPQCDQFLEFSSDLIIERREGTDICYPGRFTNEESLRQILRRSGGIGKESMGFTYSGIRTNGATSACTRSGSSFYAEMKWLLSNSDNAAFPQMTKAYRNPRNKPALIIWGVHHSESVSEQTKLYGSGNKLITVRSSKYQQSFTPNPGARRIDFHWLLLDPNDTVTFTFNGAFIAPDRTSFFRGESLGVQSDAPLDSSCRGDCFHSGGTIVSSLPFQNINSRTVGKCPRYVKQKSLLLATGMRNVPEKPKPRGLFGAIAGFIENGWEGLINGWYGFRHQNAQGEGTAADYKSTQSAIDQITGKLNRLIGKTNQQFELIDNEFNEIEQQIGNVINWTRDAMTEIWSYNAELLVAMENQHTIDLADSEMSKLYERVKKQLRENAEEDGTGCFEIFHKCDDQCMESIRNNTYDHTQYRTESLQNRIQIDPVKLSSGYKDIILWFSFGASCFLLLAIAMGLVFICIKNGNMQCTICI

SEQ ID NO: 2284 - protein, 565 aa, Artificial Sequence; identical to SEQ ID NO: 1914
  hemagglutinin__InfluenzaA__ACC61964

SEQ ID NO: 2285 - protein, 565 aa, Artificial Sequence
  hemagglutinin__InfluenzaA__ACC61975
MKVKLLVLLCTFTASYADTICIGYHANNSTDTVDTVLEKNVTVTHSVNLLEDSHNGKLCLLKGIAPLQLGNCSVAGWILGNPECELLISKESWSYIVEVPNPENGTCYPGYFADYEELREQLSSISSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGLGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2286 - protein, 565 aa, Artificial Sequence; identical to SEQ ID NO: 1910
  hemagglutinin__InfluenzaA__ACC61986

SEQ ID NO: 2287 - protein, 565 aa, Artificial Sequence
  hemagglutinin__InfluenzaA__ACD37430
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPTHTVTGVSASCSHNGKSSFYRNLLWLTGKNGLYPNLSKSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2288 - protein, 565 aa, Artificial Sequence
  hemagglutinin__InfluenzaA__ACD37507
MKAKLLVLLCTFAATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2289 - protein, 565 aa, Artificial Sequence; identical to SEQ ID NO: 2055
  hemagglutinin__InfluenzaA__ACD56113

SEQ ID NO: 2290 - protein, 565 aa, Artificial Sequence; identical to SEQ ID NO: 1914
  hemagglutinin__InfluenzaA__ACD56124

SEQ ID NO: 2291 - protein, 566 aa, Artificial Sequence; identical to SEQ ID NO: 1987
  hemagglutinin__InfluenzaA__ACD56258

SEQ ID NO: 2292 - protein, 566 aa, Artificial Sequence; identical to SEQ ID NO: 1729
  hemagglutinin__InfluenzaA__ACD56269

SEQ ID NO: 2293 - protein, 565 aa, Artificial Sequence
  hemagglutinin__InfluenzaA__ACD56280
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPGNGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECEAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2294 - protein, 562 aa, Artificial Sequence
  hemagglutinin__InfluenzaA__ACD56324
MAIIYLILLFTAVRGDQICIGYHANNSTEKVDTILERNVTVTHAKNILEKTHNGRLCKLNGIPPLELGDCSIAGWLLGNPECDRLLRVPEWSYIMEKENPRNGLCYPGSFNDYEELKHLLSSVKHFEKVRILPKDRWTQHTTTGSSRACAVSGNPSFFRNMVWLTKKESNYPVAKGSYNNTSGEQMLIIWGVHHPIDETEQRTLYQNVGTYVSVGTSTLNKRSTPDIATRPKVNGLGSRMEFSWTLLDMWDTINFESTGNLIAPEYGFKISKRGSSGIMKTERTLENCETKCQTPLGAINTTLPFHNVHPLTIGECPKYVKSEKLVLATGLRNVPQIEPRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 2295 - protein, 562 aa, Artificial Sequence
  hemagglutinin__InfluenzaA__ACD85187
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDRWTQHTTTGGSKACAVSGKPSFFRNMVWLTKKGPNYPVAKGSYNNTSGEQMLIIWGVHHPKDEAEQRALYQEVGTYVSASTSTLNKRSTPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFNNLEKRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 2296 - protein, 562 aa, Artificial Sequence
  hemagglutinin__InfluenzaA__ACD85198
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDGWTQHTTTGGSKACAVSGKPSFFRNMVWLTKKGPNYPVAKRSYNNTSGEQMLIIWGVHHPTDEAEQRALYQEVGTYVSASTSTLNKRSTPEIAARPEVNGLRSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNTQFEAVGKEFSNLEKRLENLNKKMEDGFLDVWTYNAELLVLMENERTLGFHDSNVKNLYDKVRMQLRDNVKELGNGCFEFYHKCDDECMNSVKNGTYDYPKYEEESKLKRNEIKGVKLSSMGVYQILAIYATVAGSLSLAIMMAGISFWMCSNGSLQCRICI

SEQ ID NO: 2297 - protein, 562 aa, Artificial Sequence
  hemagglutinin__InfluenzaA__ACD85209
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTQKGSNYPVAKGSYNNTSGEQMLIIWGVHHPNDETEQRTLYQNVGTYVSVGTSTLNKRSTPDIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 2298 - protein, 562 aa, Artificial Sequence
  hemagglutinin__InfluenzaA__ACD85220
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPKYSLCYPGSFNDYEELKHLLSSVKHFEKVKILPKDRWTQHTTTGGSKACAVSGEPSFFRNMVWLTKKGPNYPVAKGSYNNTSGEQMLIIWGVHHPKDEAEQRALYQNVGTYVSASTSTLNKRSTPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFNNLEKRLENLNKKMEDGFLDVWTYNAELLVLMENERTLDFHDSNVKNLYDKVRMQLRDNVKELGNGCFEFYHKCDDECMNSVKNGTYDYPKYEKESKLNRNEIKGVKLSSMGVYQILAIYATVAGSLSLAIMMAGISFWMCSNGSLQCRICI

SEQ ID NO: 2299 - protein, 562 aa, Artificial Sequence
  hemagglutinin__InfluenzaA__ACD85242
MAIIYLILLFATVRGDQICIGYHANNSTEKVDTILERNVTVTHAKDILEKTHNGKLCKLNGIPPLELGDCSIAGWLLGNPECDRLLRVPEWSYIMEKENPRYSLCYPGSLNDYEELKHLLSSVKHFEKVRILPKDRWTQHTTTGGSKACAVSGKPSFFRNMVWLTKKGPNYPVAKGSYNNTSGEQMLIIWGVHHPKDEAEQRALYQEVGTYVSASTSTLNKRSIPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSMIEKMNTQFEAVGKEFNNLEKRLENLDKKMEDGFLDVWTYNAELLVLMENERTLDFHDSNVKNLYEKVRMQLRDNVKELGNGCFEFYHKCDNECMNSVKNGTYDYPKYEEESKLKRNEIKGVKLSSMGVYQILAIYATVAGSLSLAIMVAGISFWMCSNGSLQCRICI

SEQ ID NO: 2300 - protein, 562 aa, Artificial Sequence
  hemagglutinin__InfluenzaA__ACD85253
MAIIYLILLFATVRGDQICIGYHANNSTEKVDTILERNVTVTHAKDILEKTHNGKLCKLNGIPPLELGDCSIAGWLLGNPECDRLLRVPEWSYIMEKENPRYNLCYPGSLNEYEELKHLLSSVKHFEKVRILPKDRWTQHTTTGGSKACAVSGEPSFFRNMVWLTKKGPNYPVAKGSYNNTSGEQMLIIWGVHHPNDEAEQRALYQKVGTYVSASTSTLNKRSIPEIAARPKVNGLGSRMEFFWTLLDVWDTINFESTGNLVVPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFETVGKEFNNLEKRLENLNKKMEDGFLDVWTYNAELLVLMENERTLDFHDSNVKNLYEKVRMQLRDNVKELGNGCFEFYHKCDDECMNSVKNGTYDYPKYEEESKLKRNEIKGVKLSSMGVYQILAIYATVAGSLSLAIMVAGISFWMCSNGSLQCRICI

SEQ ID NO: 2301 - protein, 566 aa, Artificial Sequence
  hemagglutinin__InfluenzaA__ACD85440
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDLGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2302 - protein, 566 aa, Artificial Sequence; identical to SEQ ID NO: 2301
  hemagglutinin__InfluenzaA__ACD85451

SEQ ID NO: 2303 - protein, 566 aa, Artificial Sequence; identical to SEQ ID NO: 2301
  hemagglutinin__InfluenzaA__ACD85462

SEQ ID NO: 2304 - protein, 566 aa, Artificial Sequence; identical to SEQ ID NO: 1928
  hemagglutinin__InfluenzaA__ACD85473

SEQ ID NO: 2305 - protein, 566 aa, Artificial Sequence
  hemagglutinin__InfluenzaA__ACD85484
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2306 - protein, 566 aa, Artificial Sequence; identical to SEQ ID NO: 1928
  hemagglutinin__InfluenzaA__ACD85495

SEQ ID NO: 2307 - protein, 566 aa, Artificial Sequence
  hemagglutinin__InfluenzaA__ACD85528
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYVSLRSLVASSGTLEFNNESFNWTGVTQNGTSSACIRRSNKSFFSRLNWLTHLKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDLGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2308 - protein, 566 aa, Artificial Sequence
  hemagglutinin__InfluenzaA__ACD85539
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRTNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2309 - protein, 566 aa, Artificial Sequence
  hemagglutinin__InfluenzaA__ACD85550
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDLGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 2310 - protein, 566 aa, Artificial Sequence; identical to SEQ ID NO: 1928
  hemagglutinin__InfluenzaA__ACD85561

SEQ ID NO: 2311 - protein, 566 aa, Artificial Sequence
  hemagglutinin__InfluenzaA__ACD85572
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNTGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2312 - protein, 566 aa, Artificial Sequence; identical to SEQ ID NO: 2308
  hemagglutinin__InfluenzaA__ACD85583

SEQ ID NO: 2313 - protein, 566 aa, Artificial Sequence
  hemagglutinin__InfluenzaA__ACD93579
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNTCIGSIRNGTYDHDVYRDEALNNRFQIKGVELKSGYKDWILWISFAISCFLLCVALLGFIMWACQKGNIRCNICI

SEQ ID NO: 2314 - protein, 566 aa, Artificial Sequence; identical to SEQ ID NO: 630
  hemagglutinin__InfluenzaA__ACF09402

SEQ ID NO: 2315 - protein, 566 aa, Artificial Sequence
  hemagglutinin__InfluenzaA__ACF22159
MKTIIALSYILCLVFAQKLPGNDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGFRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 2316 - protein, 566 aa, Artificial Sequence
  hemagglutinin__InfluenzaA__ACF22188
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIWSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGNYDHDVYRDEALNNRFQIKGVELKSGYKDWILWISFAISCFLLCVVLLGFIMWACQRGNIRCNICI

SEQ ID NO: 2317 - protein, 566 aa, Artificial Sequence; identical to SEQ ID NO: 2316
  hemagglutinin__InfluenzaA__ACF22199

SEQ ID NO: 2318 - protein, 566 aa, Artificial Sequence
  hemagglutinin__InfluenzaA__ACF22210
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2319 - protein, 566 aa, Artificial Sequence; identical to SEQ ID NO: 2318
  hemagglutinin__InfluenzaA__ACF22221

SEQ ID NO: 2320 - protein, 566 aa, Artificial Sequence; identical to SEQ ID NO: 2318
  hemagglutinin__InfluenzaA__ACF22232

SEQ ID NO: 2321 - protein, 566 aa, Artificial Sequence; identical to SEQ ID NO: 2318
  hemagglutinin__InfluenzaA__ACF22243

SEQ ID NO: 2322 - protein, 566 aa, Artificial Sequence; identical to SEQ ID NO: 2318
  hemagglutinin__InfluenzaA__ACF22254

SEQ ID NO: 2323 - protein, 566 aa, Artificial Sequence; identical to SEQ ID NO: 2318
  hemagglutinin__InfluenzaA__ACF22265

SEQ ID NO: 2324 - protein, 566 aa, Artificial Sequence; identical to SEQ ID NO: 2318
  hemagglutinin__InfluenzaA__ACF22276

SEQ ID NO: 2325 - protein, 566 aa, Artificial Sequence; identical to SEQ ID NO: 2318
  hemagglutinin__InfluenzaA__ACF22287

SEQ ID NO: 2326 - protein, 566 aa, Artificial Sequence; identical to SEQ ID NO: 2318
  hemagglutinin__InfluenzaA__ACF22298

SEQ ID NO: 2327 - protein, 566 aa, Artificial Sequence; identical to SEQ ID NO: 2318
  hemagglutinin__InfluenzaA__ACF22320

SEQ ID NO: 2328 - protein, 566 aa, Artificial Sequence; identical to SEQ ID NO: 2318
  hemagglutinin__InfluenzaA__ACF22342

SEQ ID NO: 2329 - protein, 566 aa, Artificial Sequence
  hemagglutinin__InfluenzaA__ACF22364
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIESRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2330 - protein, 566 aa, Artificial Sequence; identical to SEQ ID NO: 2308
  hemagglutinin__InfluenzaA__ACF22408

SEQ ID NO: 2331 - protein, 566 aa, Artificial Sequence; identical to SEQ ID NO: 1928
  hemagglutinin__InfluenzaA__ACF41669

SEQ ID NO: 2332 - protein, 565 aa, Artificial Sequence; identical to SEQ ID NO: 1914
  hemagglutinin__InfluenzaA__ACF41680

SEQ ID NO: 2333 - protein, 562 aa, Artificial Sequence
  hemagglutinin__InfluenzaA__ACF41691
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDGWTQHETDGGSKACAVSGKPSFFRNMVWLTKKGPNYPVAKRSYNNTSGEQMLIIWGVHHPNDEAEQRALYQEVGTYVSASTSTLNKRSTPEIAARPKVSGLGSRMEFSWTLLDVWDTISFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDRITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDDECMNSVKNGTYDYPKYEEESKLKRNEIKGVELSSMGVYQILAIYATVAGSLSLAIMIAGISFWMCSNGSLQCRICI

SEQ ID NO: 2334 - protein, 566 aa, Artificial Sequence; identical to SEQ ID NO: 2316
  hemagglutinin__InfluenzaA__ACF41735

SEQ ID NO: 2335 - protein, 566 aa, Artificial Sequence
  hemagglutinin__InfluenzaA__ACF41790
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEDFTWTGVTQNGGSNACKRGPGSGFFSRLNWLTKSGSTYPVLDVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2336 - protein, 566 aa, Artificial Sequence
  hemagglutinin__InfluenzaA__ACF41823
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSRQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHNVYRDEALNNRFQIKGVELKSGYKDWILWISFAISCFLLCVVLLGFIMWACQRGNIRCNICI

SEQ ID NO: 2337 - protein, 565 aa, Artificial Sequence
  hemagglutinin__InfluenzaA__ACF41834
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPNLKNSYVNKKGKEVLVLWGIHHPSNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 2338 - protein, 566 aa, Artificial Sequence
  hemagglutinin__InfluenzaA__ACF41856
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKSEYKYPALNVTMPNNGKFDKLYIWGVHHPSTDRDQTSLYVRASGRVTVSTKRSQQTVTPNIGSRPWVRGQSSRISIYWTIVKPGDILLINSTGNLIAPRGYFKIRNGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2339 - protein, 565 aa, Artificial Sequence
  hemagglutinin__InfluenzaA__ACF41867
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVTASCSHNGKSSFYRNLLWLTEKNGLYPNLSNSYVNNKEKEVLVLWGVHHPSNIRDQRAIYHTENAYVSVVSSHYSRRFTPEIAKRPKVRGQEGRINYYWTLLEPGDTIIFEANGNLIAPWYAFALSRGFGSGIITSNAPMNECDAKCQTPQGAINSSLPFQNVHPVTIGECPKYVRSTKLRMVTGLRNIPSIQSRGLFGAIAGFIEGGWTGMMDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2340 - protein, 565 aa, Artificial Sequence; identical to SEQ ID NO: 2115
  hemagglutinin__InfluenzaA__ACF41878

SEQ ID NO: 2341 - protein, 566 aa, Artificial Sequence
  hemagglutinin__InfluenzaA__ACF41922
MKAKLLVLLCAFTATYADTICIGYHANNSTDTVDTVLEKNVTVTHSVNLLEDSHNGKLCRLKGIAPLQLGNCSVAGWILGNPKCESLFSKESWSYIAETPNPENGTCYPGYFADYEELREQLSSVSSFERFEIFPKESSWPNHTVTKGVTASCSHNGKSSFYRNLLWLTEKNGLYPNLSKSYVNNKEKEVLVLWGVHHPSNIRDQRAIYHTENAYVSVVSSHYSRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENGRTLDFHDSNVKNLYEKVKSQLKNNAKEIGNGCFEFYHKCNNECMESVKNGTYDYPKYSEESKLNRGKIDGVKLESMGVYQILAIYSTVASSLVLLVSLGAISFWMCSNGSLQCRICI

SEQ ID NO: 2342 - protein, 562 aa, Artificial Sequence
  hemagglutinin__InfluenzaA__ACF54389
MAIIYLILLFATVRGDQICIGYHANNSTEKVDTILERNVTVTHAKDILEKTHNGKLCKLNGIPPLELGDCSIAGWLLGNPECDRLLRVPEWSYIMEKENPRYSLCYPGSLNDYEELKHLLSSVKHFEKVRILPKDRWTQHTTTGGSKACAVSGKPSFFRNMVWLTKKGTNYPVAKGSYNNTSGEQMLIIWGVHHPIDEAEQRALYQEVGTYVSASTSTLNKRSIPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNEQGSGYAADKESTQKAFDGITNKVNSVIEKMNTQFEAVGKEFNNLEKRLENLNKKMEDGFLDVWTYNAELLVLMENERTLDFHDSNVKNLYEKVRMQLRDNVKELGNGCFEFYHKCDDECMNSVKNGTYDYPKYEEESKLKRNEIKGVKLSSMGVYQILAIYATVAGSLSLAIMVAGISFWMCSNGSLQCRICI

SEQ ID NO: 2343 - protein, 566 aa, Artificial Sequence; identical to SEQ ID NO: 2316
  hemagglutinin__InfluenzaA__ACF54400

SEQ ID NO: 2344 - protein, 566 aa, Artificial Sequence; identical to SEQ ID NO: 2318
  hemagglutinin__InfluenzaA__ACF54411

SEQ ID NO: 2345 - protein, 566 aa, Artificial Sequence; identical to SEQ ID NO: 2318
  hemagglutinin__InfluenzaA__ACF54422

SEQ ID NO: 2346 - protein, 566 aa, Artificial Sequence; identical to SEQ ID NO: 2329
  hemagglutinin__InfluenzaA__ACF54433

SEQ ID NO: 2347 - protein, 566 aa, Artificial Sequence; identical to SEQ ID NO: 2318
  hemagglutinin__InfluenzaA__ACF54444

SEQ ID NO: 2348 - protein, 566 aa, Artificial Sequence; identical to SEQ ID NO: 2336
  hemagglutinin__InfluenzaA__ACF54466

SEQ ID NO: 2349 - protein, 562 aa, Artificial Sequence
  hemagglutinin__InfluenzaA__ACF54477
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 2350 - protein, 562 aa, Artificial Sequence
  hemagglutinin__InfluenzaA__ACF54499
MAIIYLILLFTAVRGDQICIGYHANNSTETVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 2351 - protein, 562 aa, Artificial Sequence; identical to SEQ ID NO: 2350
  hemagglutinin__InfluenzaA__ACF54510

SEQ ID NO: 2352 - protein, 562 aa, Artificial Sequence; identical to SEQ ID NO: 2350
  hemagglutinin__InfluenzaA__ACF54521

SEQ ID NO: 2353 - protein, 566 aa, Artificial Sequence
  hemagglutinin__InfluenzaA__ACF54532
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELTSGYKDWILWISFAISCFLLCVALLGFIMWACQKGNIRCNICI

SEQ ID NO: 2354 - protein, 566 aa, Artificial Sequence
  hemagglutinin__InfluenzaA__ACF54543
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYVSLRSLVASSGTLEFNNESFNWTGVTQNGTSSACIRRSNNSFFSRLNWLTHLKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDLGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2355 - protein, 566 aa, Artificial Sequence
  hemagglutinin__InfluenzaA__ACF54565
MKTIIALSYILCLVFSQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWAGVTQNGTSSACKRRSNKSFFSRLNWLTHLKYKYPALNVTMPNNEKFDKLYIWGVHHPVTDSDQISLYAQASGRITVSTKRSQQTVIPNIGYRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 2356 - protein, 566 aa, Artificial Sequence
  hemagglutinin__InfluenzaA__ACF54576
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTQLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2357 - protein, 565 aa, Artificial Sequence
  hemagglutinin__InfluenzaA__ACF54598
MKAKLLVLLYAFVATDADTICIGYHANNSTDTVDTIFEKNVAVTHSVNLLEDRHNGKLCKLKGIAPLQLGKCNIIGWLLGNPECDSLLPARSWSYIVETPNSENGACYPGDFIDYEELREQLSSVSSLERFEIFPKESSWPNHTFNGVTASCSHRGKSSFYRNLLWLTKKGDSYPKLTNSYVNNKGKEVLVLWGVHHPSSSDEQQSLYSNGNAYVSVASSNYNRRFTPEIAARPKVKDQHGRMNYYWTLLEPGDTIIFEATGNLIAPWYAFALSRGFESGIITSNASMHECNTKCQTPQGSINSNLPFQNIHPVTIGECPKYVRSTKLRMVTGLRNIPSIQYRGLFGAIAGFIEGGWTGMIDGWYGYHHQNEQGSGYAADQKSTQNAINGITNKVNSIIEKMNTQFTAVGKEFNNLEKRMENLNKKVDDGFLDIWTYNAELLVLLENGRTLDFHDLNVKNLYEKVKSQLKNNAKEIGNGCFEFYHKCDNECMESVRNGTYDYPKYSEESKLNREKIDGVKLESMGVYQILAIYSTVASSLVLLVSLGAISFWMCSNGSLQCRICI

SEQ ID NO: 2358 - protein, 567 aa, Artificial Sequence
  hemagglutinin__InfluenzaA__ACG50699
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYMVEKANPANDLCYPGNFNDYEELKHLLSRINHFEKIQIIPKSSWSDHEASLGVSSACPYQGSSSFFRNVVWLIKKNNAYPTIKRSYNNTNQEDLLVLWGIHHPNDEAEQTRLYQNPTTYISVGTSTLNQRLIPKIATRSKVNGQSGRMDFFWTILKPNDAINFESNGNFIAPEYAYKIVKKGDSAIMKSEVEYGNCNTKCQTPMGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 2359 - protein, 566 aa, Artificial Sequence; identical to SEQ ID NO: 1928
  hemagglutinin__InfluenzaA__ACG70142

SEQ ID NO: 2360 - protein, 566 aa, Artificial Sequence; identical to SEQ ID NO: 1928
  hemagglutinin__InfluenzaA__ACG70153

SEQ ID NO: 2361 - protein, 566 aa, Artificial Sequence
  hemagglutinin__InfluenzaA__ACG80410
MKTIIALSYILCLVFAQKLPGNDNSTATLCLGHHAVPNGTIVRTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRNGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2362 - protein, 566 aa, Artificial Sequence
  hemagglutinin__InfluenzaA__ACG80420
MQTIIALSYILCLVFAQKLPGNDNSTATLCLGHHAVPNGTIVRTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRNGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2363 - protein, 566 aa, Artificial Sequence; identical to SEQ ID NO: 2361
  hemagglutinin__InfluenzaA__ACG80426

SEQ ID NO: 2364 - protein, 566 aa, Artificial Sequence; identical to SEQ ID NO: 2361
  hemagglutinin__InfluenzaA__ACG80430

SEQ ID NO: 2365 - protein, 566 aa, Artificial Sequence
  hemagglutinin__InfluenzaA__ACG80436
MKTIIALSYILCLVFAQKFPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAALDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 2366 - protein, 566 aa, Artificial Sequence
  hemagglutinin__InfluenzaA__ACG80445
MKTIIALSYILCLVFAQKLPGNDNSTATLCLGHHAVPNGTIVRTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRNGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKNQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2367 - protein, 566 aa, Artificial Sequence; identical to SEQ ID NO: 2361
  hemagglutinin__InfluenzaA__ACG80454

SEQ ID NO: 2368 - protein, 566 aa, Artificial Sequence; identical to SEQ ID NO: 2361
  hemagglutinin__InfluenzaA__ACG80463

SEQ ID NO: 2369 - protein, 566 aa, Artificial Sequence
  hemagglutinin__InfluenzaA__ACG80472
MKTIIALSYILCLVFAQKLPGNDNSTATLCLGHHAVPNGTIVRTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAALDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 2370 - protein, 566 aa, Artificial Sequence
  hemagglutinin__InfluenzaA__ACH69558
MKTIIALSYILCLVFAQKLPGNDNSTATLCLGHHAVPNGTIVKTITNDQIEVTNATELVQSSSTGGICNSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLRFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2371 - protein, 566 aa, Artificial Sequence
  hemagglutinin__InfluenzaA__ACH69569
MKTIIALSYILCLVFAQKLPGNDNSTATLCLGHHAVPNGTIVKTITNDQIEVTNATELVQSSSTGGICNSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNSLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2372 - protein, 566 aa, Artificial Sequence
  hemagglutinin__InfluenzaA__ACH69580
MKTIIALSYILCLVFAQKLPGNDNSTATLCLGHHAVPNGTIVKTITNDQIEVTNATELVQSSSTGGICDSPHQILDGENCTLIDALLGDPQCDDFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2373 - protein, 566 aa, Artificial Sequence
  hemagglutinin__InfluenzaA__ACH69591
MKTIIALSYILCLAFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSINSFFSRLNWLHQLKYRYPALNVTMPNNDKFDKLYIWGVHHPSTDSDQISVYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNKLIEKTNEKFHQIENEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2374 - protein, 566 aa, Artificial Sequence
  hemagglutinin__InfluenzaA__ACH69602
MKTIIALSYILCLAFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSINSFFSRLNWLHQLKYRYPALNVTMPNNDKFDKLYIWGVHHPSTDSDQISVYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNKLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2375 - protein, 566 aa, Artificial Sequence
  hemagglutinin__InfluenzaA__ACH69613
MKTIIALSYILCLAFAQKLPGNDNSTPTLCLGHHAVPNGTLVKTITNDQIEVTNATELVQSSSTGGICDSPHQIIDGENCTLIDALLGDPHCDGFQNKEWDLFVERSKAYSNCYPYDVPDYASLRSLVASSGTLEFNNESFNWTGVAQNGTSSACKRRSINSFFSRLNWLHQLKYRYPALNVTMPNNDKFDKLYIWGVHHPSTDSDQISVYAQASGRVTVSTKRSQQTVIPNIGSRPWVRGISSRISIYWTIVKPGDILLINSTGNPIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGLRHQNSEGTGQAADLKSTQAAINQINGKLNKLIEKTNEKFHQIENEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2376 - protein, 566 aa, Artificial Sequence; identical to SEQ ID NO: 630
  hemagglutinin__InfluenzaA__ACH82060

SEQ ID NO: 2377 - protein, 566 aa, Artificial Sequence; identical to SEQ ID NO: 2316
  hemagglutinin__InfluenzaA__ACI06123

SEQ ID NO: 2378 - protein, 566 aa, Artificial Sequence; identical to SEQ ID NO: 2316
  hemagglutinin__InfluenzaA__ACI06126

SEQ ID NO: 2379 - protein, 566 aa, Artificial Sequence; identical to SEQ ID NO: 2316
  hemagglutinin__InfluenzaA__ACI06127

SEQ ID NO: 2380 - protein, 566 aa, Artificial Sequence; identical to SEQ ID NO: 2316
  hemagglutinin__InfluenzaA__ACI06129

SEQ ID NO: 2381 - protein, 566 aa, Artificial Sequence; identical to SEQ ID NO: 2316
  hemagglutinin__InfluenzaA__ACI06130

SEQ ID NO: 2382 - protein, 566 aa, Artificial Sequence; identical to SEQ ID NO: 2316
  hemagglutinin__InfluenzaA__ACI06132

SEQ ID NO: 2383 - protein, 566 aa, Artificial Sequence; identical to SEQ ID NO: 2318
  hemagglutinin__InfluenzaA__ACI06133

SEQ ID NO: 2384 - protein, 566 aa, Artificial Sequence; identical to SEQ ID NO: 2318
  hemagglutinin__InfluenzaA__ACI06134

SEQ ID NO: 2385 - protein, 566 aa, Artificial Sequence; identical to SEQ ID NO: 2318
  hemagglutinin__InfluenzaA__ACI06135

SEQ ID NO: 2386 - protein, 566 aa, Artificial Sequence; identical to SEQ ID NO: 2318
  hemagglutinin__InfluenzaA__ACI06136

SEQ ID NO: 2387 - protein, 566 aa, Artificial Sequence; identical to SEQ ID NO: 2318
  hemagglutinin__InfluenzaA__ACI06137

SEQ ID NO: 2388 - protein, 566 aa, Artificial Sequence; identical to SEQ ID NO: 2318
  hemagglutinin__InfluenzaA__ACI06138

SEQ ID NO: 2389 - protein, 566 aa, Artificial Sequence; identical to SEQ ID NO: 2318
  hemagglutinin__InfluenzaA__ACI06139

SEQ ID NO: 2390 - protein, 566 aa, Artificial Sequence; identical to SEQ ID NO: 2318
  hemagglutinin__InfluenzaA__ACI06140

SEQ ID NO: 2391 - protein, 566 aa, Artificial Sequence; identical to SEQ ID NO: 2318
  hemagglutinin__InfluenzaA__ACI06141

SEQ ID NO: 2392 - protein, 566 aa, Artificial Sequence; identical to SEQ ID NO: 2318
  hemagglutinin__InfluenzaA__ACI06142

SEQ ID NO: 2393 - protein, 566 aa, Artificial Sequence; identical to SEQ ID NO: 2318
  hemagglutinin__InfluenzaA__ACI06143

SEQ ID NO: 2394 - protein, 566 aa, Artificial Sequence
  hemagglutinin__InfluenzaA__ACI06144
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNRLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2395 - protein, 566 aa, Artificial Sequence; identical to SEQ ID NO: 2318
  hemagglutinin__InfluenzaA__ACI06145

SEQ ID NO: 2396 - protein, 566 aa, Artificial Sequence
  hemagglutinin__InfluenzaA__ACI06146
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSSPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNYEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2397 - protein, 566 aa, Artificial Sequence; identical to SEQ ID NO: 2318
  hemagglutinin__InfluenzaA__ACI06147

SEQ ID NO: 2398 - protein, 566 aa, Artificial Sequence; identical to SEQ ID NO: 2318
  hemagglutinin__InfluenzaA__ACI06148

SEQ ID NO: 2399 - protein, 566 aa, Artificial Sequence
  hemagglutinin__InfluenzaA__ACI06149
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSRQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2400 - protein, 566 aa, Artificial Sequence; identical to SEQ ID NO: 2329
  hemagglutinin__InfluenzaA__ACI06151

SEQ ID NO: 2401 - protein, 566 aa, Artificial Sequence; identical to SEQ ID NO: 2329
  hemagglutinin__InfluenzaA__ACI06152

SEQ ID NO: 2402 - protein, 566 aa, Artificial Sequence
  hemagglutinin__InfluenzaA__ACI06153
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDELVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2403 - protein, 566 aa, Artificial Sequence
  hemagglutinin__InfluenzaA__ACI06155
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIESRPWVRGLSSRISIYWTIVKPGDVLVINSNGNLIAPRGYFKMRTGKSSIVRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2404 - protein, 566 aa, Artificial Sequence; identical to SEQ ID NO: 2329
  hemagglutinin__InfluenzaA__ACI06156

SEQ ID NO: 2405 - protein, 566 aa, Artificial Sequence; identical to SEQ ID NO: 2329
  hemagglutinin__InfluenzaA__ACI06157

SEQ ID NO: 2406 - protein, 566 aa, Artificial Sequence; identical to SEQ ID NO: 2329
  hemagglutinin__InfluenzaA__ACI06158

SEQ ID NO: 2407 - protein, 566 aa, Artificial Sequence; identical to SEQ ID NO: 2329
  hemagglutinin__InfluenzaA__ACI06159

SEQ ID NO: 2408 - protein, 566 aa, Artificial Sequence; identical to SEQ ID NO: 2318
  hemagglutinin__InfluenzaA__ACI06160

SEQ ID NO: 2409 - protein, 566 aa, Artificial Sequence
  hemagglutinin__InfluenzaA__ACI06161
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIESRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRKGTYDHDVYRDEALNNRFQIKGVELKSGYKDWILWISFAISCFLLCVVLLGFIMWACQRGNIRCNICI

SEQ ID NO: 2410 - protein, 566 aa, Artificial Sequence
  hemagglutinin__InfluenzaA__ACI06162
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIESRPWVRGLSSRISIYWTIVNPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2411 - protein, 566 aa, Artificial Sequence
  hemagglutinin__InfluenzaA__ACI06163
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRKGTYDHDVYRDEALNNRFQIKGVELKSGYKDWILWISFAISCFLLCVVLLGFIMWACQRGNIRCNICI

SEQ ID NO: 2412 - protein, 566 aa, Artificial Sequence
  hemagglutinin__InfluenzaA__ACI06164
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRINIYWTIVKPGDVLVINSNGNLIAPRGYFKMRNGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2413 - protein, 566 aa, Artificial Sequence
  hemagglutinin__InfluenzaA__ACI06165
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRNGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2414 - protein, 566 aa, Artificial Sequence
  hemagglutinin__InfluenzaA__ACI06166
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWIRGLSSRINIYWTIVKPGDVLVINSNGNLIAPRGYFKMRNGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2415 - protein, 566 aa, Artificial Sequence; identical to SEQ ID NO: 2399
  hemagglutinin__InfluenzaA__ACI06167

SEQ ID NO: 2416 - protein, 566 aa, Artificial Sequence
  hemagglutinin__InfluenzaA__ACI06168
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRKQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2417 - protein, 566 aa, Artificial Sequence; identical to SEQ ID NO: 2318
  hemagglutinin__InfluenzaA__ACI06169

SEQ ID NO: 2418 - protein, 566 aa, Artificial Sequence; identical to SEQ ID NO: 2335
  hemagglutinin__InfluenzaA__ACI06171

SEQ ID NO: 2419 - protein, 566 aa, Artificial Sequence; identical to SEQ ID NO: 2335
  hemagglutinin__InfluenzaA__ACI06172

SEQ ID NO: 2420 - protein, 566 aa, Artificial Sequence
  hemagglutinin__InfluenzaA__ACI06173
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLEINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2421 - protein, 566 aa, Artificial Sequence; identical to SEQ ID NO: 2335
  hemagglutinin__InfluenzaA__ACI06174

SEQ ID NO: 2422 - protein, 566 aa, Artificial Sequence; identical to SEQ ID NO: 2336
  hemagglutinin__InfluenzaA__ACI06175

SEQ ID NO: 2423 - protein, 566 aa, Artificial Sequence; identical to SEQ ID NO: 2336
  hemagglutinin__InfluenzaA__ACI06176

SEQ ID NO: 2424 - protein, 566 aa, Artificial Sequence; identical to SEQ ID NO: 2336
  hemagglutinin__InfluenzaA__ACI06177

SEQ ID NO: 2425 - protein, 562 aa, Artificial Sequence
  hemagglutinin__InfluenzaA__ACI25724
MAIIYLILLFATVRGDQICIGYHANNSTEKVDTILERNVTVTHAKDILEKTHNGKLCKLNGIPPLELGDCSIAGWLLGNPECDRLLRVPEWSYIMERENPRYSLCYPGSLNDYEELKHLLSSVKHFEKVRILPKDRWTQHTTTGGSKACAVSGKPSFFRNMVWLTKKGPNYPVAKGSYNNTSGEQMLIIWGVHHPKDEAEQRALYQEVGTYVSASTSTLNKRSIPEIAARPEVNGLGSRMEFSWTLLDVWDTINFESTGNLVAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFNNLEKRLENLNKKMEDGFLDVWTYNAELLVLMENERTLDFHDSNVKNLYEKVRMQLRDNVKELGNGCFEFYHKCDDECMNSVKNGTYDYPKYEEESKLKRNEIKGVKLSSMGVYQILAIYATVAGSLSLAIMVAGISFWMCSNGSLQCRICI

SEQ ID NO: 2426 - protein, 566 aa, Artificial Sequence
  hemagglutinin__InfluenzaA__ACI25746
MKTIIALSYIFCLALGQYLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVIDSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2427 - protein, 566 aa, Artificial Sequence
  hemagglutinin__InfluenzaA__ACI25757
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYLVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYNHDVYRDEALNNRFQIKGVELKSGYKDWILWISFAISCFLLCVVLLGFIMWACQRGNIRCNICI

SEQ ID NO: 2428 - protein, 566 aa, Artificial Sequence; identical to SEQ ID NO: 2316
  hemagglutinin__InfluenzaA__ACI25768

SEQ ID NO: 2429 - protein, 566 aa, Artificial Sequence
  hemagglutinin__InfluenzaA__ACI25779
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIWSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2430 - protein, 566 aa, Artificial Sequence
  hemagglutinin__InfluenzaA__ACI25790
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIWSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRSGTYDHDVYRDEALNNRFQIKGVELKSGYKDWILWISFAISCFLLCVVLLGFIMWACQRGNIRCNICI

SEQ ID NO: 2431 - protein, 566 aa, Artificial Sequence
  hemagglutinin__InfluenzaA__ACI25801
MKTIIALSYIFCLALGQDLPGNDNSTATLCLGHHAVPNGTLVKTITDDQIEVTNATELVQSSSTGKICNNPHRILDGINCTLIDALLGDPHCDVFQNETWDLFVERSKAFSNCYPYDVPDYASLRSLVASSGTLEFITEDFTWTGVTQNGGSNACKRGPGSGFFSRLNWLTKSGSTYPVLDVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 2432 - protein, 562 aa, Artificial Sequence; identical to SEQ ID NO: 2350
  hemagglutinin__InfluenzaA__ACI26274

SEQ ID NO: 2433 - protein, 565 aa, Artificial Sequence
  hemagglutinin__InfluenzaA__ACI26307
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPVTDNDQIFLYAQSGRITVSTKRSQQTVIPNIGSRPRVRNSPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2434 - protein, 566 aa, Artificial Sequence
  hemagglutinin__InfluenzaA__ACI26362
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2435 - protein, 566 aa, Artificial Sequence
  hemagglutinin__InfluenzaA__ACI26373
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWAGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2436 - protein, 566 aa, Artificial Sequence; identical to SEQ ID NO: 2301
  hemagglutinin__InfluenzaA__ACI26395

SEQ ID NO: 2437 - protein, 566 aa, Artificial Sequence
  hemagglutinin__InfluenzaA__ACI26406
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKHPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2438 - protein, 566 aa, Artificial Sequence; identical to SEQ ID NO: 1928
  hemagglutinin__InfluenzaA__ACI26417

SEQ ID NO: 2439 - protein, 566 aa, Artificial Sequence
  hemagglutinin__InfluenzaA__ACI26428
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFNWTGVTQNGTSSSCKRRSNNSFFSRLNWLTHLKFKYPALNVTMPNNEKFDKLYIWGVHHPVTDNDQIRLYAQASGRITVSTKRSQQTVIPNIGYRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2440 - protein, 565 aa, Artificial Sequence
  hemagglutinin__InfluenzaA__ACI26439
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGNQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKSQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 2441 - protein, 565 aa, Artificial Sequence; identical to SEQ ID NO: 2440
  hemagglutinin__InfluenzaA__ACI26450

SEQ ID NO: 2442 - protein, 566 aa, Artificial Sequence
  hemagglutinin__InfluenzaA__ACI26461
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 2443 - protein, 565 aa, Artificial Sequence
  hemagglutinin__InfluenzaA__ACI26472
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPVTDNDQIFLYAQSGRITVSTKRSQQTVIPNIGYRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2444 - protein, 566 aa, Artificial Sequence; identical to SEQ ID NO: 2435
  hemagglutinin__InfluenzaA__ACI26483

SEQ ID NO: 2445 - protein, 566 aa, Artificial Sequence
  hemagglutinin__InfluenzaA__ACI26505
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWAGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIRSIRNGTYDHDVYRDEALNNRFQIKGVELKSGYKDWILWISFAISCFLLCVALLGFIMWACQKGNIRCNICI

SEQ ID NO: 2446 - protein, 566 aa, Artificial Sequence; identical to SEQ ID NO: 2434
  hemagglutinin__InfluenzaA__ACI26516

SEQ ID NO: 2447 - protein, 566 aa, Artificial Sequence; identical to SEQ ID NO: 2435
  hemagglutinin__InfluenzaA__ACI26527

SEQ ID NO: 2448 - protein, 566 aa, Artificial Sequence
  hemagglutinin__InfluenzaA__ACI26538
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPDKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2449 - protein, 566 aa, Artificial Sequence
  hemagglutinin__InfluenzaA__ACI26549
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYSCKRGSVNSFFSRLNWLHESEYKYPALNVTMPNNGKFDKLYIWGVHHPSTDREQTKLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEEYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2450 - protein, 566 aa, Artificial Sequence
  hemagglutinin__InfluenzaA__ACI26560
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPITDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2451 - protein, 566 aa, Artificial Sequence
  hemagglutinin__InfluenzaA__ACI26571
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTKLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 2452 - protein, 566 aa, Artificial Sequence
  hemagglutinin__InfluenzaA__ACI26593
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEDFNWTGVAQSGESYACKRGSVKSFFSRLNWLHKSDYKYPALNVTMPNNGKFDKLYIWGVHHPSTDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2453 - protein, 565 aa, Artificial Sequence
  hemagglutinin__InfluenzaA__ACI32715
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNTVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2454 - protein, 565 aa, Artificial Sequence
  hemagglutinin__InfluenzaA__ACI32716
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCTICI

SEQ ID NO: 2455 - protein, 565 aa, Artificial Sequence
  hemagglutinin__InfluenzaA__ACI32717
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAMNSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAINFWMCSNGSLQCKICI

SEQ ID NO: 2456 - protein, 565 aa, Artificial Sequence
  hemagglutinin__InfluenzaA__ACI32718
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTATGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEVGNGCFEFYHKCNDECMESVKNGTYDYPKYSEESKLNREKIDGVKLESMGVYQILAIYSTVASSLVLLVSLGAISFWMCSNGSLQCTICI

SEQ ID NO: 2457 - protein, 565 aa, Artificial Sequence; identical to SEQ ID NO: 2454
  hemagglutinin__InfluenzaA__ACI32719

SEQ ID NO: 2458 - protein, 565 aa, Artificial Sequence; identical to SEQ ID NO: 2454
  hemagglutinin__InfluenzaA__ACI32720

SEQ ID NO: 2459 - protein, 565 aa, Artificial Sequence
  hemagglutinin__InfluenzaA__ACI32721
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRISYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2460 - protein, 565 aa, Artificial Sequence; identical to SEQ ID NO: 2454
  hemagglutinin__InfluenzaA__ACI32722

SEQ ID NO: 2461 - protein, 565 aa, Artificial Sequence
  hemagglutinin__InfluenzaA__ACI32723
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICF

SEQ ID NO: 2462 - protein, 565 aa, Artificial Sequence
  hemagglutinin__InfluenzaA__ACI32724
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLKPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCKICI

SEQ ID NO: 2463 - protein, 565 aa, Artificial Sequence; identical to SEQ ID NO: 1385
  hemagglutinin__InfluenzaA__ACI32725

SEQ ID NO: 2464 - protein, 565 aa, Artificial Sequence
  hemagglutinin__InfluenzaA__ACI32726
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLEKRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGIYQILAIYSTVTSSLVLLVSLGAISFWMCSNGSLQCRICI

SEQ ID NO: 2465 - protein, 565 aa, Artificial Sequence
  hemagglutinin__InfluenzaA__ACI32727
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSISSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVTLGAISFWMCSNGSLQCTICI

SEQ ID NO: 2466 - protein, 565 aa, Artificial Sequence
  hemagglutinin__InfluenzaA__ACI32729
MKVKLLVLLCTFTATYADTICIGYHANNSTDTVDTVLEKNVTVTHSVNLLEDSHNGKLCLLKGIAPLQLGNCSVAGWILGNPECELLIPKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGVTNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2467 - protein, 565 aa, Artificial Sequence; identical to SEQ ID NO: 2466
  hemagglutinin__InfluenzaA__ACI32730

SEQ ID NO: 2468 - protein, 565 aa, Artificial Sequence
  hemagglutinin__InfluenzaA__ACI32731
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQKALYHTENAYVSVVSSHYSRKFNPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCKICI

SEQ ID NO: 2469 - protein, 565 aa, Artificial Sequence
  hemagglutinin__InfluenzaA__ACI32732
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCTICI

SEQ ID NO: 2470 - protein, 565 aa, Artificial Sequence
  hemagglutinin__InfluenzaA__ACI32733
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQKALYHTENAYVSVVSSHYSRKFNSEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCTICI

SEQ ID NO: 2471 - protein, 565 aa, Artificial Sequence
  hemagglutinin__InfluenzaA__ACI32734
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKKKEVLVLWGVHHPPNIGDQKALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCTICI

SEQ ID NO: 2472 - protein, 565 aa, Artificial Sequence
  hemagglutinin__InfluenzaA__ACI32736
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTATGVSASCSHNGKSSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVRNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2473 - protein, 565 aa, Artificial Sequence
  hemagglutinin__InfluenzaA__ACI32737
MKVKLLVLLCTFTATYADTICIGYHANNSTDTVDTVLEKNVTVTHSVNLLENSHNGKLCLLKGIAPLQLGNCSVAGWILGNPECELLIPKESWSYIVEIPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGLGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLRNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2474 - protein, 565 aa, Artificial Sequence
  hemagglutinin__InfluenzaA__ACI32739
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLILWGVHHPPNIGNQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCKICI

SEQ ID NO: 2475 - protein, 565 aa, Artificial Sequence
  hemagglutinin__InfluenzaA__ACI32740
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPKHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCPNGSLQCTICI

SEQ ID NO: 2476 - protein, 565 aa, Artificial Sequence
  hemagglutinin__InfluenzaA__ACI32741
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPKHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCPNGSLQCKICI

SEQ ID NO: 2477 - protein, 565 aa, Artificial Sequence
  hemagglutinin__InfluenzaA__ACI32742
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCKICI

SEQ ID NO: 2478 - protein, 565 aa, Artificial Sequence
  hemagglutinin__InfluenzaA__ACI32743
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKKSSWPNHTVTGVSASCSHNGKSSFYRNLLWLTGKNGLYPNLSKSYANNKEKEVLILWGVHHPPNIGNQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 2479 - protein, 566 aa, Artificial Sequence
  hemagglutinin__InfluenzaA__ACJ09818
MKTIIALSYILCLVFAQKLPGNDNSTATLCLGHHAVPNGTIVKTITNDQVEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAMSCFLLCVALLGFIMWACQKGNIRCNICI

SEQ ID NO: 2480 - protein, 560 aa, Artificial Sequence
  hemagglutinin__InfluenzaA__ACJ67533
METISLITILLVVTASNADKICIGHQSTNSTETVDTLTETNVPVTHAKELLHTEHNGMLCATSLGHPLILDTCTIEGLVYGNPSCDLLLEGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYAEQTNLYIRNDTTTSVTTEDLNRTFKPVIGPRPLVNGLQGRIDYYWSVLKPGQTLRVRSNGNLIAPWYGHVLSGGSHGRILKTDLKSGSCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESERTYKILTIYSTVASSLVLAMGFAAFLFWAMSNGSCRCNICI

SEQ ID NO: 2481 - protein, 567 aa, Artificial Sequence
  hemagglutinin__InfluenzaA__ACJ68607
MEKIVLLLAIVSLVKSDQICIGYHANNSTEQVDTIMEKNVTVTHAQDILEKTHNGKLCDLDGVKPLILGDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 2482 - protein, 567 aa, Artificial Sequence
  hemagglutinin__InfluenzaA__ACJ68609
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLRREEISGVKLESIGTYQILSIYSTVASSLALAIMVAGLSLWMCSNGSLQCRICI

SEQ ID NO: 2483 - protein, 567 aa, Artificial Sequence
  hemagglutinin__InfluenzaA__ACJ68610
MEKIVLFLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIIKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 2484 - protein, 567 aa, Artificial Sequence
  hemagglutinin__InfluenzaA__ACJ68611
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASLGVSSACPYQGMPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVGYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMVAGLSLWMCSNGSLQCRICI

SEQ ID NO: 2485 - protein, 567 aa, Artificial Sequence
  hemagglutinin__InfluenzaA__ACJ68612
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWPDHEASSGVSSACPYQGTPSFFRNVVWLIKKNNTYPTIKRSYNNTNQEDLLILWGIHHSNNAAEQTKLYQNPTTYISVGTSTLNLRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGAYQILSIYSTVASSLALAIMVAGLSLWMCSNGSLQCRICI

SEQ ID NO: 2486 - protein, 567 aa, Artificial Sequence
  hemagglutinin__InfluenzaA__ACJ68613
MEKIVLFLAIVSHVKSDQICIGYHANNSTEQVDTIMEKNVTVTHAQDILEKTHNGKLCDLGGVKPLILRDCSVAGWLLGNPMCDEFINVPEWSYIVEKANPANDLCYPGNFNDYEELKHLLSRINHFEKIQIIPKSSWSDHEASSGVSSVCPYQGTPSFFRNVVWLIKKNNTYPTIKKSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 2487 - protein, 568 aa, Artificial Sequence
  hemagglutinin__InfluenzaA__ACJ68614
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPVNDLCYPGNFNDYEELKHLLSRINHFEKIQIIPKSSWSDHEASSGVSSACPYQGRSSFFRNVVWLIKKNNTYPTIKRSYNNTNQEDLLVLWGIHHPNDAAEQTRLYQNPTTYISVGTSTLNQRLVPKLATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNERGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 2488 - protein, 565 aa, Artificial Sequence
  hemagglutinin__InfluenzaA__ACK99007
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2489 - protein, 565 aa, Artificial Sequence
  hemagglutinin__InfluenzaA__ACK99008
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMEVYQILAIYSTVASSLVLLVSLGAISFWMCSNGSLQCRICI

SEQ ID NO: 2490 - protein, 565 aa, Artificial Sequence
  hemagglutinin__InfluenzaA__ACK99009
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTITFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2491 - protein, 565 aa, Artificial Sequence; identical to SEQ ID NO: 2488
  hemagglutinin__InfluenzaA__ACK99011

SEQ ID NO: 2492 - protein, 565 aa, Artificial Sequence
  hemagglutinin__InfluenzaA__ACK99012
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLISLGAISFWMCSNGSLQCRICI

SEQ ID NO: 2493 - protein, 565 aa, Artificial Sequence; identical to SEQ ID NO: 2488
  hemagglutinin__InfluenzaA__ACK99013

SEQ ID NO: 2494 - protein, 565 aa, Artificial Sequence
  hemagglutinin__InfluenzaA__ACK99014
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFTLSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2495 - protein, 565 aa, Artificial Sequence; identical to SEQ ID NO: 2488
  hemagglutinin__InfluenzaA__ACK99016

SEQ ID NO: 2496 - protein, 565 aa, Artificial Sequence; identical to SEQ ID NO: 2488
  hemagglutinin__InfluenzaA__ACK99018

SEQ ID NO: 2497 - protein, 565 aa, Artificial Sequence; identical to SEQ ID NO: 2488
  hemagglutinin__InfluenzaA__ACK99023

SEQ ID NO: 2498 - protein, 565 aa, Artificial Sequence
  hemagglutinin__InfluenzaA__ACK99026
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPITIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2499 - protein, 565 aa, Artificial Sequence; identical to SEQ ID NO: 2172
  hemagglutinin__InfluenzaA__ACK99027

SEQ ID NO: 2500 - protein, 565 aa, Artificial Sequence
  hemagglutinin__InfluenzaA__ACK99028
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPKGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2501 - protein, 565 aa, Artificial Sequence
  hemagglutinin__InfluenzaA__ACK99029
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEISKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2502 - protein, 565 aa, Artificial Sequence; identical to SEQ ID NO: 2488
  hemagglutinin__InfluenzaA__ACK99030

SEQ ID NO: 2503 - protein, 565 aa, Artificial Sequence; identical to SEQ ID NO: 2488
  hemagglutinin__InfluenzaA__ACK99031

SEQ ID NO: 2504 - protein, 565 aa, Artificial Sequence; identical to SEQ ID NO: 2488
  hemagglutinin__InfluenzaA__ACK99032

SEQ ID NO: 2505 - protein, 565 aa, Artificial Sequence; identical to SEQ ID NO: 2488
  hemagglutinin__InfluenzaA__ACK99033

SEQ ID NO: 2506 - protein, 565 aa, Artificial Sequence
  hemagglutinin__InfluenzaA__ACK99034
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRDFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2507 - protein, 565 aa, Artificial Sequence
  hemagglutinin__InfluenzaA__ACK99035
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSAFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEISKRPKVRDQEGRINYYWTLLEPGDTIIFEANGNLIAPRYAFALSRGFGSGIINSNTPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2508 - protein, 566 aa, Artificial Sequence; identical to SEQ ID NO: 2338
  hemagglutinin__InfluenzaA__ACK99421

SEQ ID NO: 2509 - protein, 562 aa, Artificial Sequence
  hemagglutinin__InfluenzaA__ACK99432
MAIIYLILLFTAVRGDQICIGYHANNSTEKIDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDRWTQHTTTGGSMACAVSGKPSFFRNMVWLTTKGPNYPVAQGSYNNTSGEQMLIIWGVHHPNDEAEQRALYQKVGTYVSASTSTLYKRSIPEIAARPKVNGLGSRMEFSWTLLDMWDTINFESTGNLVAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDNECMDSVKNGTYDYPKYEEESKLNRNEIKGVKLSSMGVYQILAIYATVAGSLSLAIMMAGISFWMCSNGSLQCRICI

SEQ ID NO: 2510 - protein, 566 aa, Artificial Sequence
  hemagglutinin__InfluenzaA__ACK99443
MKAKLLVLLCAFTATDADTICIGYHANNSTDTVDTVLEKNVTVTHSVNLLEDSHNGKLCRLKGIAPLQLGNCSIAGWILGNPECESLFSKESWSYIAETPNSENGTCYPGYFADYEELREQLSSVSSFERFEIFPKESSWPNHTVTKGVTAACSHNGKSSFYRNLLWLTEKNGLYPNLSKSYVNNKEKEVLVLWGVHHPSNIGDQRAIYHTENAYVSVVSSHYSRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSVQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2511 - protein, 566 aa, Artificial Sequence
  hemagglutinin__InfluenzaA__ACK99465
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAEKPNPENGTCYPGYFADYEELREQLSSVSSFERFEIFPKESSWPNHTVTKGVTASCSHNGKSSFYKNLLWLTKKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 2512 - protein, 566 aa, Artificial Sequence
  hemagglutinin__InfluenzaA__ACK99476
MKTIIALSYILCMVFAQKLPGNDNSTATLCLGHHAVPNGTLVKTITNDQIEVTNATELVQSSSTGRICDSPHRILDGKNCTLIDALLGDPHCDDFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPRTDSDQTSLYVQASGRVTVSTKRSQQTVIPNIGSSPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2513 - protein, 565 aa, Artificial Sequence; identical to SEQ ID NO: 1914
  hemagglutinin__InfluenzaA__ACL12063

SEQ ID NO: 2514 - protein, 566 aa, Artificial Sequence
  hemagglutinin__InfluenzaA__ACL12129
MKTIIALSYILCLVFAQKLPGNDNSTATLCLGHHAVPNGTLVKTITNDQIEVTNATELVQSSSTGRICGSPHRILDGKNCTLIDALLGDPHCDGFQNKEWDLFVERSKAYSNCYPYDVPDYASLRSLVASSGTLEFINEDFNWTGVAQDGGSYACKRGSVNSFFSRLNWLHKLEYKYPALNVTMPNNGKFDKLYIWGVHHPSTDSDQTSLYVRASGRVTVSTKRSQQTVTPNIGSRPWVRGQSSRISIYWTIVKPGDILLIDSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFQQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2515 - protein, 566 aa, Artificial Sequence; identical to SEQ ID NO: 2356
  hemagglutinin__InfluenzaA__ACL12140

SEQ ID NO: 2516 - protein, 565 aa, Artificial Sequence; identical to SEQ ID NO: 2440
  hemagglutinin__InfluenzaA__ACL12151

SEQ ID NO: 2517 - protein, 566 aa, Artificial Sequence; identical to SEQ ID NO: 2434
  hemagglutinin__InfluenzaA__ACL12162

SEQ ID NO: 2518 - protein, 566 aa, Artificial Sequence
  hemagglutinin__InfluenzaA__ACL12173
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAINQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2519 - protein, 566 aa, Artificial Sequence
  hemagglutinin__InfluenzaA__ACL12184
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 2520 - protein, 566 aa, Artificial Sequence; identical to SEQ ID NO: 2434
  hemagglutinin__InfluenzaA__ACL12195

SEQ ID NO: 2521 - protein, 566 aa, Artificial Sequence
  hemagglutinin__InfluenzaA__ACL12217
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDVLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2522 - protein, 566 aa, Artificial Sequence; identical to SEQ ID NO: 2434
  hemagglutinin__InfluenzaA__ACL12228

SEQ ID NO: 2523 - protein, 566 aa, Artificial Sequence; identical to SEQ ID NO: 2434
  hemagglutinin__InfluenzaA__ACL12239

SEQ ID NO: 2524 - protein, 566 aa, Artificial Sequence
  hemagglutinin__InfluenzaA__ACL12250
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYVSLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 2525 - protein, 566 aa, Artificial Sequence
  hemagglutinin__InfluenzaA__ACL12261
MKAKLLVLLCAFTATDADTICIGYHANNSTDTVDTVLEKNVTVTHSVNLLEDSHNGKLCRLKGIAPLQLGNCSIAGWILGNPECESLFSKKSWSYIAETPNSENGTCYPGYFADYEELREQLSSVSSFERFEIFPKESSWPNHTVTKGVTAACSHKGRSSFYRNLLWLTEKNGLYPNLSKSYVNNKEKEVLVLWGVHHPSNIGDQRAIYHTENAYVSVVSSHYNRRFTPEIAKRPKVRGQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2526 - protein, 562 aa, Artificial Sequence
  hemagglutinin__InfluenzaA__ACN32272
MAIIYLILLFTAVRGDQICIGYHANNSTEKIDTILERNVTVTHAKDILEKTHNGKLCKLNGIPPLELGDCSIAGWLLGNPECDRLLRVPEWSYIMEKENPRYSLCYPGSFNDYEELKHLLSSVKHFEKVKILPKDRWTQHTTTGGSMACAVSGKPSFFRNMVWLTTKGPNYPVAQGSYNNTSGEQMLIIWGVHHPNDEAEQRALYQNVGTYVSASTSTLYKRSIPEIAARPKVNGLGSRMEFSWTLLDMWDTINFESTGNLVAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDNECMDSVKNGTYDYPKYEEESKLNRNEIKGVKLSSMGVYQILAIYATVAGSLSLAIMMAGISFWMCSNGSLQCRICI

SEQ ID NO: 2527 - protein, 566 aa, Artificial Sequence
  hemagglutinin__InfluenzaA__ACN32283
MKTIIALSYILCLVSAQKFPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2528 - protein, 566 aa, Artificial Sequence
  hemagglutinin__InfluenzaA__ACN32474
MKTIIALSYILCLVSAQKLPGNDNSTATLCLGHHAVPNGTIVKTITNDQIEVTNATELVQSSSTGEICDSPHQVLDGENCTLIDALLGDPQCDGFQNKKWDLFVERSKAYSNCYPYDVPDYTSLRSLVASSGTLEFNNESFNWTGVTQNGTSSACIRRSNNSFFSRLNWLTHLKFKYPALNMTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHEVYRDEALNNRFQIKGVELKSGYKDWILWISFAISCFLLCVALLGFIMWACQKGNIRCNICI

SEQ ID NO: 2529 - protein, 565 aa, Artificial Sequence; identical to SEQ ID NO: 2488
  hemagglutinin__InfluenzaA__ACN32501

SEQ ID NO: 2530 - protein, 566 aa, Artificial Sequence
  hemagglutinin__InfluenzaA__ACN32534
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 2531 - protein, 566 aa, Artificial Sequence
  hemagglutinin__InfluenzaA__ACN32545
MKTIIALSYILCLVFAQKLPGNDNSTATLCLGHHAVPNGTIVKTITNDQIEVTNATELVQSSSTGEICDSPHQILDGENCTLIDALLGDPHCDGFQNKKWDLFVERSKAYSNCYPYDVPDYASLRSLIASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2532 - protein, 565 aa, Artificial Sequence
  hemagglutinin__InfluenzaA__ACN32793
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSESYANNKEKEVLVLWGVHHPPNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2533 - protein, 565 aa, Artificial Sequence; identical to SEQ ID NO: 1957
  hemagglutinin__InfluenzaA__ACN32804

SEQ ID NO: 2534 - protein, 565 aa, Artificial Sequence; identical to SEQ ID NO: 1945
  hemagglutinin__InfluenzaA__ACN32815

SEQ ID NO: 2535 - protein, 565 aa, Artificial Sequence; identical to SEQ ID NO: 1955
  hemagglutinin__InfluenzaA__ACN32826

SEQ ID NO: 2536 - protein, 566 aa, Artificial Sequence; identical to SEQ ID NO: 2434
  hemagglutinin__InfluenzaA__ACN32848

SEQ ID NO: 2537 - protein, 566 aa, Artificial Sequence
  hemagglutinin__InfluenzaA__ACN32870
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 2538 - protein, 566 aa, Artificial Sequence; identical to SEQ ID NO: 2537
  hemagglutinin__InfluenzaA__ACN32892

SEQ ID NO: 2539 - protein, 566 aa, Artificial Sequence; identical to SEQ ID NO: 2434
  hemagglutinin__InfluenzaA__ACN32903

SEQ ID NO: 2540 - protein, 566 aa, Artificial Sequence
  hemagglutinin__InfluenzaA__ACN32914
MKTIIALSYILCLAFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2541 - protein, 566 aa, Artificial Sequence; identical to SEQ ID NO: 2434
  hemagglutinin__InfluenzaA__ACN32925

SEQ ID NO: 2542 - protein, 566 aa, Artificial Sequence
  hemagglutinin__InfluenzaA__ACN32936
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRIKNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 2543 - protein, 566 aa, Artificial Sequence; identical to SEQ ID NO: 2434
  hemagglutinin__InfluenzaA__ACN32947

SEQ ID NO: 2544 - protein, 566 aa, Artificial Sequence
  hemagglutinin__InfluenzaA__ACN32958
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERNKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2545 - protein, 566 aa, Artificial Sequence
  hemagglutinin__InfluenzaA__ACN32969
MKTIIALSYILCLVSAQKLPGNDNSTATLCLGHHAVPNGTIVKTITNDQIEVTNATELVQSSSTGEICDSPHQVLDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKLRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHEVYRDEALNNRFQIKGVELKSGYKDWILWISFAISCFLLCVALLGFIMWACQKGNIRCNICI

SEQ ID NO: 2546 - protein, 566 aa, Artificial Sequence
  hemagglutinin__InfluenzaA__ACN32980
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAHSNCYPYDVPDYASLRSLVASSGTLEFNNESFNWTGVTQNGTSSACIRRSKNSFFSRLNWLTHLKFKYPALNVTMPNDEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACVGSIRNGTYDHDVYRDEALNNRFQIKGVELKSGYKDWILWISFAISCFLLCVALLGFIMWACQKGNIRCNICI

SEQ ID NO: 2547 - protein, 566 aa, Artificial Sequence; identical to SEQ ID NO: 2434
  hemagglutinin__InfluenzaA__ACN32991

SEQ ID NO: 2548 - protein, 566 aa, Artificial Sequence; identical to SEQ ID NO: 2434
  hemagglutinin__InfluenzaA__ACN33002

SEQ ID NO: 2549 - protein, 566 aa, Artificial Sequence; identical to SEQ ID NO: 2434
  hemagglutinin__InfluenzaA__ACN33013

SEQ ID NO: 2550 - protein, 566 aa, Artificial Sequence
  hemagglutinin__InfluenzaA__ACN33035
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYVWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2551 - protein, 566 aa, Artificial Sequence; identical to SEQ ID NO: 2434
  hemagglutinin__InfluenzaA__ACN33046

SEQ ID NO: 2552 - protein, 566 aa, Artificial Sequence; identical to SEQ ID NO: 2434
  hemagglutinin__InfluenzaA__ACN33057

SEQ ID NO: 2553 - protein, 566 aa, Artificial Sequence; identical to SEQ ID NO: 2434
  hemagglutinin__InfluenzaA__ACN33068

SEQ ID NO: 2554 - protein, 566 aa, Artificial Sequence; identical to SEQ ID NO: 2537
  hemagglutinin__InfluenzaA__ACN33079

SEQ ID NO: 2555 - protein, 565 aa, Artificial Sequence
  hemagglutinin__InfluenzaA__ACN33090
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPSNIGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2556 - protein, 565 aa, Artificial Sequence; identical to SEQ ID NO: 1914
  hemagglutinin__InfluenzaA__ACN33101

SEQ ID NO: 2557 - protein, 566 aa, Artificial Sequence; identical to SEQ ID NO: 2537
  hemagglutinin__InfluenzaA__ACN33112

SEQ ID NO: 2558 - protein, 565 aa, Artificial Sequence; identical to SEQ ID NO: 2488
  hemagglutinin__InfluenzaA__ACN33123

SEQ ID NO: 2559 - protein, 565 aa, Artificial Sequence; identical to SEQ ID NO: 2488
  hemagglutinin__InfluenzaA__ACN33145

SEQ ID NO: 2560 - protein, 566 aa, Artificial Sequence; identical to SEQ ID NO: 2434
  hemagglutinin__InfluenzaA__ACN33156

SEQ ID NO: 2561 - protein, 566 aa, Artificial Sequence
  hemagglutinin__InfluenzaA__ACN33178
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFHIKGVELKSGYKDWILWISFAISCFLLCIALLGFIMWACQKGNIRCNICI

SEQ ID NO: 2562 - protein, 566 aa, Artificial Sequence; identical to SEQ ID NO: 2434
  hemagglutinin__InfluenzaA__ACN33189

SEQ ID NO: 2563 - protein, 566 aa, Artificial Sequence
  hemagglutinin__InfluenzaA__ACN33200
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVEPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 2564 - protein, 566 aa, Artificial Sequence
  hemagglutinin__InfluenzaA__ACN33211
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALSNRFQIKGVELKSGYKDWILWISFAISCFLLCVALLGFIMWACQKGNIRCNICI

SEQ ID NO: 2565 - protein, 565 aa, Artificial Sequence; identical to SEQ ID NO: 1956
  hemagglutinin__InfluenzaA__ACN42981

SEQ ID NO: 2566 - protein, 565 aa, Artificial Sequence; identical to SEQ ID NO: 2190
  hemagglutinin__InfluenzaA__ACN42992

SEQ ID NO: 2567 - protein, 566 aa, Artificial Sequence; identical to SEQ ID NO: 2434
  hemagglutinin__InfluenzaA__ACN43003

SEQ ID NO: 2568 - protein, 566 aa, Artificial Sequence
  hemagglutinin__InfluenzaA__ACN43014
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWIGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGNCNSECITPNGSIPNDKPFQNVNRITYGSCPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 2569 - protein, 566 aa, Artificial Sequence; identical to SEQ ID NO: 2434
  hemagglutinin__InfluenzaA__ACN43025

SEQ ID NO: 2570 - protein, 566 aa, Artificial Sequence; identical to SEQ ID NO: 2434
  hemagglutinin__InfluenzaA__ACN43036

SEQ ID NO: 2571 - protein, 566 aa, Artificial Sequence; identical to SEQ ID NO: 2434
  hemagglutinin__InfluenzaA__ACN43047

SEQ ID NO: 2572 - protein, 566 aa, Artificial Sequence
  hemagglutinin__InfluenzaA__ACN43058
MKTIIALSYILCLVFAQKLPGNDNSTATLCLGHHAVPNGTIVKTITNDQIEVTNATELVQSSSTGEICGSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2573 - protein, 566 aa, Artificial Sequence; identical to SEQ ID NO: 2434
  hemagglutinin__InfluenzaA__ACN43069

SEQ ID NO: 2574 - protein, 566 aa, Artificial Sequence; identical to SEQ ID NO: 2537
  hemagglutinin__InfluenzaA__ACN43080

SEQ ID NO: 2575 - protein, 566 aa, Artificial Sequence
  hemagglutinin__InfluenzaA__ACN72617
MEAKLFVLFCAFTALKADTICVGYHANNSTDTVDTILEKNVTVTHSVNLLENSHNGKLCSLNGKAPLQLGNCNVAGWILGNPECDLLLTANSWSYIIETSDSKNGACYPGEFADYEELREQLSTVSSFERFEIFPKATSWPNHETTKGTTVACSHSGANSFYRNLLWIVKKGNSYPKLSKSYTNNKGKEVLVIWGVHHPPTDSDQQTLYQNKHTYVSVGSSKYYQRFTPEIVTRPKVREQAGRMNYYWTLLDQGDTITFEATGNLIAPWHAFALNKGSNSGIMMSDAHVHNCTTKCQTPHGALKGNLPFQNVHPITIGECPKYVKSTQLRMATGLRNIPSIQSRGLFGAIAGFIEGGWTGMIDGWYGYHHQNEQGSGYAADRKSTQIAIDGISNKVNSVIEKMNIQFTSVGKEFNNLEKRIENLNKKVDDGFLDVWTYNAELLILLENERTLDFHDFNVKNLYEKVKSQLRNNAKEIGNGCFEFYHKCDNECMESVKNGTYNYPRYSEESKLNREEIDGVKLESVGVHQILAIYSTVASSLVLLVSLGAISFWMCSNGSLQCRICI

SEQ ID NO: 2576 - protein, 566 aa, Artificial Sequence
  hemagglutinin__InfluenzaA__ACN72632
MKTVIALSYVFCLVFGQDLPGKGNNTATLCLGHHAVPNGTLVKTITDDQIEVTNATELVQNFSIGKICKNPHRILDGANCTLIDSLLGDPHCDGFQNEKWDLFIERSKAFSNCYPYDVPEYTSLRSLIASSGTLEFTNEDFNWTGVTQNGGSSACKRGPNNSFFSRLNWLYKSGNTYPMLNVTMPNSDDFDKLYIWGVHHPSTDREQTNLYIQASGKIIVSTKRSQQTIIPNIGSRPWVRGLSSRISIYWTIVKPGDILIINSNGNLIAPRGYFKIQTGKSSVMRSDAPIGTCNYECITPNGSIPNDKPFQNVNRITYGACPHYIKQNTLKLATGMRNIPERQTRGIFGAIAGFIENGWEGMVNGWYGFRHQNSEGIGQAADLKSTQAAINQINGKLNRVIEKTNEKFHQIEKEFSEVEGRIQDLERYVEDTKIDLWSYNAELLVALENQHTIDLTDSEMNKLFEKTRKQLRENAEDMGNGCFKIYHKCDNSCMESIRNGTYDHNEYRDEAVNNRFQIKSVELKSGYKDWILWISFAISCFLLCAVWLGFIIWACQKGNIRCNICI

SEQ ID NO: 2577 - protein, 566 aa, Artificial Sequence; identical to SEQ ID NO: 2434
  hemagglutinin__InfluenzaA__ACN76478

SEQ ID NO: 2578 - protein, 566 aa, Artificial Sequence
  hemagglutinin__InfluenzaA__ACN76489
MKTIIALGYILCLVSAQKLPGNDNSTATLCLGHHAVPNGTIVKTITNDQIEVTNATELVQSSSTGEICDSPHQVLDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHEVYRDEALNNRFQIKGVELKSGYKDWILWISFAISCFLLCVALLGFIMWACQKGNIRCNICI

SEQ ID NO: 2579 - protein, 566 aa, Artificial Sequence; identical to SEQ ID NO: 2434
  hemagglutinin__InfluenzaA__ACN76500

SEQ ID NO: 2580 - protein, 566 aa, Artificial Sequence; identical to SEQ ID NO: 2434
  hemagglutinin__InfluenzaA__ACN76511

SEQ ID NO: 2581 - protein, 566 aa, Artificial Sequence; identical to SEQ ID NO: 2434
  hemagglutinin__InfluenzaA__ACN76522

SEQ ID NO: 2582 - protein, 566 aa, Artificial Sequence; identical to SEQ ID NO: 2434
  hemagglutinin__InfluenzaA__ACO36331

SEQ ID NO: 2583 - protein, 566 aa, Artificial Sequence
  hemagglutinin__InfluenzaA__ACO36342
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEIEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 2584 - protein, 566 aa, Artificial Sequence
  hemagglutinin__InfluenzaA__ACO36364
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2585 - protein, 566 aa, Artificial Sequence; identical to SEQ ID NO: 2301
  hemagglutinin__InfluenzaA__ACO36375

SEQ ID NO: 2586 - protein, 565 aa, Artificial Sequence; identical to SEQ ID NO: 2488
  hemagglutinin__InfluenzaA__ACO36397

SEQ ID NO: 2587 - protein, 566 aa, Artificial Sequence; identical to SEQ ID NO: 2301
  hemagglutinin__InfluenzaA__ACO36408

SEQ ID NO: 2588 - protein, 566 aa, Artificial Sequence; identical to SEQ ID NO: 1928
  hemagglutinin__InfluenzaA__ACO36419

SEQ ID NO: 2589 - protein, 566 aa, Artificial Sequence; identical to SEQ ID NO: 1928
  hemagglutinin__InfluenzaA__ACO36430

SEQ ID NO: 2590 - protein, 566 aa, Artificial Sequence
  hemagglutinin__InfluenzaA__ACO36441
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 2591 - protein, 566 aa, Artificial Sequence
  hemagglutinin__InfluenzaA__ACO36452
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSSCKRRSNNSFFSRLNWLTHLKYKYPALNVTMPNNEKFDKLYIWGVHHPGTDSDQISLYAQASGRITISTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2592 - protein, 566 aa, Artificial Sequence
  hemagglutinin__InfluenzaA__ACO36463
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFIERSKAYSNCYPYDVPDYASLRSLVASSGTLEFNNESFNWTGVTQNGTSSACQRRSNKSFFSRLNWLTHLKFKYPALNVTMPNNEKFDKLYIWGVHHPGTDNDQISLYAQTSGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPERQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFVLCVALLGFIMWACQKGNIRCNICI

SEQ ID NO: 2593 - protein, 566 aa, Artificial Sequence
  hemagglutinin__InfluenzaA__ACO36474
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSSCKRRSNNSFFSRLNWLTHLRYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGDCPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2594 - protein, 566 aa, Artificial Sequence
  hemagglutinin__InfluenzaA__ACO36496
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNGFFSRLNWLTHLKFKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2595 - protein, 566 aa, Artificial Sequence
  hemagglutinin__InfluenzaA__ACO36518
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGTCPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKLGYKDWILWISFAISCFLLCVALLGFIMWACQKGNIRCNICI

SEQ ID NO: 2596 - protein, 566 aa, Artificial Sequence
  hemagglutinin__InfluenzaA__ACO36551
MKTIIALSHILCLVFAQKPPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNETYDHDVYRDEALNNRFQIKGVELKSGYKDWILWISFAISCFLLCVALLGFIMWACQKGNIRCNICI

SEQ ID NO: 2597 - protein, 566 aa, Artificial Sequence
  hemagglutinin__InfluenzaA__ACO36562
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNETYDHDVYRDEALNNRFQIKGVELKSGYKDWILWISFAISCFLLCVALLGFIMWACQKGNIRCNICI

SEQ ID NO: 2598 - protein, 566 aa, Artificial Sequence
  hemagglutinin__InfluenzaA__ACO36573
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNETYDHDVYRDEALNNRFQIKGVELKSGYKDWILWISFAISCFLLCVALLGFIMWACQKGNIRCNICI

SEQ ID NO: 2599 - protein, 566 aa, Artificial Sequence
  hemagglutinin__InfluenzaA__ACO36584
MKTIIALSYILCLVFSQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKKSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNETYDHDVYRDEALNNRFQIKGVELKSGYKDWILWISFAISCFLLCVALLGFIMWACQKGNIRCNICI

SEQ ID NO: 2600 - protein, 566 aa, Artificial Sequence; identical to SEQ ID NO: 630
  hemagglutinin__InfluenzaA__ACO36595

SEQ ID NO: 2601 - protein, 566 aa, Artificial Sequence
  hemagglutinin__InfluenzaA__ACO36606
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFKNESFNWTGVTQNGTSSACKRRSNNSFFSRLNWLTHLKFKYPALNVTMPNNEKFDKLYIWGVHHPGTDNDQIFLYAQASGRITVSTQRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2602 - protein, 566 aa, Artificial Sequence; identical to SEQ ID NO: 630
  hemagglutinin__InfluenzaA__ACO36617

SEQ ID NO: 2603 - protein, 566 aa, Artificial Sequence; identical to SEQ ID NO: 630
  hemagglutinin__InfluenzaA__ACO36628

SEQ ID NO: 2604 - protein, 566 aa, Artificial Sequence
  hemagglutinin__InfluenzaA__ACO36639
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCFALLGFIMWACQKGNIRCNICI

SEQ ID NO: 2605 - protein, 566 aa, Artificial Sequence
  hemagglutinin__InfluenzaA__ACO36661
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDIKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2606 - protein, 566 aa, Artificial Sequence; identical to SEQ ID NO: 630
  hemagglutinin__InfluenzaA__ACO36683

SEQ ID NO: 2607 - protein, 566 aa, Artificial Sequence; identical to SEQ ID NO: 2597
  hemagglutinin__InfluenzaA__ACO37122

SEQ ID NO: 2608 - protein, 566 aa, Artificial Sequence
  hemagglutinin__InfluenzaA__ACO94514
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2609 - protein, 566 aa, Artificial Sequence
  hemagglutinin__InfluenzaA__ACO94515
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2610 - protein, 566 aa, Artificial Sequence; identical to SEQ ID NO: 2434
  hemagglutinin__InfluenzaA__ACO94516

SEQ ID NO: 2611 - protein, 566 aa, Artificial Sequence; identical to SEQ ID NO: 2434
  hemagglutinin__InfluenzaA__ACO94672

SEQ ID NO: 2612 - protein, 566 aa, Artificial Sequence
  hemagglutinin__InfluenzaA__ACO94683
MKTIIALSYILCLVSAQKLPGNDNSTATLCLGHHAVPNGTIVKTITNDQIEVTNATELVQSSSTGEICDSPHQVLDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFTEVEGRIQDLEKYVEDTKIDLWSYNAELLVALENQHTIDLTDSEMNKLFEKTKKQLRENAEDMGNGCFKIYHKCDNACIGSIRNGTYDHEVYRDEALNNRFQIKGVELKSGYKDWILWISFAISCFLLCVALLGFIMWACQKGNIRCNICI

SEQ ID NO: 2613 - protein, 566 aa, Artificial Sequence; identical to SEQ ID NO: 2434
  hemagglutinin__InfluenzaA__ACO94694

SEQ ID NO: 2614 - protein, 565 aa, Artificial Sequence; identical to SEQ ID NO: 2488
  hemagglutinin__InfluenzaA__ACO94705

SEQ ID NO: 2615 - protein, 566 aa, Artificial Sequence
  hemagglutinin__InfluenzaA__ACO94727
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCLLLCVALLGFIMWACQKGNIRCNICI

SEQ ID NO: 2616 - protein, 566 aa, Artificial Sequence
  hemagglutinin__InfluenzaA__ACO94738
MKTIIALSYIQCLVFAQKFPGNDNSTATLCLGHHAVPNGTVVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYARASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 2617 - protein, 566 aa, Artificial Sequence; identical to SEQ ID NO: 2537
  hemagglutinin__InfluenzaA__ACO94760

SEQ ID NO: 2618 - protein, 566 aa, Artificial Sequence
  hemagglutinin__InfluenzaA__ACO94771
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCLLLCVALLGFIMWACQKGNIRCNICI

SEQ ID NO: 2619 - protein, 566 aa, Artificial Sequence; identical to SEQ ID NO: 2434
  hemagglutinin__InfluenzaA__ACO94782

SEQ ID NO: 2620 - protein, 566 aa, Artificial Sequence; identical to SEQ ID NO: 2434
  hemagglutinin__InfluenzaA__ACO94793

SEQ ID NO: 2621 - protein, 565 aa, Artificial Sequence
  hemagglutinin__InfluenzaA__ACO94804
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGNQRALYHTENAYVSVVSSHYSRKFTPEIAKRPKVRDQEGRINYYWTLLEPGDTIIFEANGNLIAPRYAFALSRGFGSGIINSNAPMDGCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSYVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2622 - protein, 566 aa, Artificial Sequence; identical to SEQ ID NO: 2301
  hemagglutinin__InfluenzaA__ACO94815

SEQ ID NO: 2623 - protein, 566 aa, Artificial Sequence; identical to SEQ ID NO: 2308
  hemagglutinin__InfluenzaA__ACO94848

SEQ ID NO: 2624 - protein, 565 aa, Artificial Sequence; identical to SEQ ID NO: 2488
  hemagglutinin__InfluenzaA__ACO94859

SEQ ID NO: 2625 - protein, 565 aa, Artificial Sequence
  hemagglutinin__InfluenzaA__ACO94870
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKGKEVLVLWGVHHPPNIGDQNTLYHTENAYVSVVSSHYSRKFTPEIAKRPKVRDQEGRINYYWTLLEPGDTIIFEANGNLIAPRYAFALNRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2626 - protein, 566 aa, Artificial Sequence
  hemagglutinin__InfluenzaA__ACO94881
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSSCKRRSNNSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHRCDNACIGSIRNGTYDHDVYRDEALNNRFQIKGVELKSGYKDWILWISFAISCFLLCVALLGFIMWACQKGNIRCNICI

SEQ ID NO: 2627 - protein, 566 aa, Artificial Sequence
  hemagglutinin__InfluenzaA__ACO94892
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACQRRSNKSFFSRLNWLTHLKFKYPALNVTMPNNEKFDKLYIWGVHHPGTDNDQISLYAQTSGRITISTKRSQQTVIPNIGSRPRVRDVPSRISIYWTIVKPGDILLINSTGNLIAPRGYFKIRSGKSSIMRSDAPIVKCNSECITPNGSIPNDKPFQNVNRITYGACPRYVKQNTLKLATGMRNVPERQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2628 - protein, 566 aa, Artificial Sequence
  hemagglutinin__InfluenzaA__ACO94903
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSEAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2629 - protein, 566 aa, Artificial Sequence
  hemagglutinin__InfluenzaA__ACO94925
MKTIIALSYILCLVFAQKLPGNDNSTATLCLGHHAVPNGTVVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2630 - protein, 566 aa, Artificial Sequence
  hemagglutinin__InfluenzaA__ACO94936
MKTIIALSYILCLVFAQKLPGNDNSTATLCLGHHAVPNGTIVKTITNDQIEVTNATELVQSSSTGGICDSPHQILDGEDCTLIDALLGDPQCDGFQNKKWDLFVERSKAYSNCYPYDVPDYASLRSLVASSGTLEFNNESFDWTGVTQNGTSSSCKRRSNNSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2631 - protein, 566 aa, Artificial Sequence
  hemagglutinin__InfluenzaA__ACO94947
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFRIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2632 - protein, 566 aa, Artificial Sequence
  hemagglutinin__InfluenzaA__ACO95153
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNENFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2633 - protein, 566 aa, Artificial Sequence; identical to SEQ ID NO: 2598
  hemagglutinin__InfluenzaA__ACO95171

SEQ ID NO: 2634 - protein, 566 aa, Artificial Sequence
  hemagglutinin__InfluenzaA__ACO95193
MKTIIALSYILCLVFAQKLPGNDKSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNENFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCSSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2635 - protein, 566 aa, Artificial Sequence; identical to SEQ ID NO: 2597
  hemagglutinin__InfluenzaA__ACO95204

SEQ ID NO: 2636 - protein, 566 aa, Artificial Sequence
  hemagglutinin__InfluenzaA__ACO95215
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNETYDHDVYRDEALNNRFQIKSVELKSGYKDWILWISFAISCFLLCVALLGFIMWACQKGNIRCNICI

SEQ ID NO: 2637 - protein, 566 aa, Artificial Sequence; identical to SEQ ID NO: 281
  hemagglutinin__InfluenzaA__ACO95226

SEQ ID NO: 2638 - protein, 566 aa, Artificial Sequence; identical to SEQ ID NO: 630
  hemagglutinin__InfluenzaA__ACO95248

SEQ ID NO: 2639 - protein, 566 aa, Artificial Sequence
  hemagglutinin__InfluenzaA__ACO95270
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPVTDNNQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2640 - protein, 566 aa, Artificial Sequence; identical to SEQ ID NO: 2434
  hemagglutinin__InfluenzaA__ACO95281

SEQ ID NO: 2641 - protein, 566 aa, Artificial Sequence
  hemagglutinin__InfluenzaA__ACO95292
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2642 - protein, 566 aa, Artificial Sequence; identical to SEQ ID NO: 2537
  hemagglutinin__InfluenzaA__ACO95303

SEQ ID NO: 2643 - protein, 565 aa, Artificial Sequence
  hemagglutinin__InfluenzaA__ACO95382
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKEGSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2644 - protein, 565 aa, Artificial Sequence
  hemagglutinin__InfluenzaA__ACO95415
MKVKLLVLLCTFTATYADTICIGYHANNSTDTIDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKGKEVLVLWGVHHPPNIGDQNTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2645 - protein, 566 aa, Artificial Sequence
  hemagglutinin__InfluenzaA__ACO95426
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSSCKRRSNNSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2646 - protein, 566 aa, Artificial Sequence; identical to SEQ ID NO: 1795
  hemagglutinin__InfluenzaA__ACO95437

SEQ ID NO: 2647 - protein, 566 aa, Artificial Sequence
  hemagglutinin__InfluenzaA__ACO95448
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQINLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2648 - protein, 566 aa, Artificial Sequence; identical to SEQ ID NO: 630
  hemagglutinin__InfluenzaA__ACO95459

SEQ ID NO: 2649 - protein, 566 aa, Artificial Sequence
  hemagglutinin__InfluenzaA__ACO95470
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGRCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2650 - protein, 566 aa, Artificial Sequence
  hemagglutinin__InfluenzaA__ACO95481
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNLPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2651 - protein, 566 aa, Artificial Sequence; identical to SEQ ID NO: 630
  hemagglutinin__InfluenzaA__ACO95492

SEQ ID NO: 2652 - protein, 566 aa, Artificial Sequence; identical to SEQ ID NO: 630
  hemagglutinin__InfluenzaA__ACO95503

SEQ ID NO: 2653 - protein, 566 aa, Artificial Sequence; identical to SEQ ID NO: 630
  hemagglutinin__InfluenzaA__ACO95514

SEQ ID NO: 2654 - protein, 566 aa, Artificial Sequence; identical to SEQ ID NO: 630
  hemagglutinin__InfluenzaA__ACO95536

SEQ ID NO: 2655 - protein, 566 aa, Artificial Sequence; identical to SEQ ID NO: 630
  hemagglutinin__InfluenzaA__ACO95547

SEQ ID NO: 2656 - protein, 566 aa, Artificial Sequence
  hemagglutinin__InfluenzaA__ACP41963
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2657 - protein, 565 aa, Artificial Sequence; identical to SEQ ID NO: 2643
  hemagglutinin__InfluenzaA__ACP44192

SEQ ID NO: 2658 - protein, 565 aa, Artificial Sequence; identical to SEQ ID NO: 2643
  hemagglutinin__InfluenzaA__ACP44203

SEQ ID NO: 2659 - protein, 565 aa, Artificial Sequence
  hemagglutinin__InfluenzaA__ACP44225
MKVKLLVLLCTFTATYADTICIGYHANNSTDTVDTVLEKNVTVTHSVNLLENSHNGKLCLLKGIAPLQLGNCSVAGWILGNPECGLLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSKESKLNREKIDGVKLESMGVYQILAIYSTVASSLVLLVSLGAISFWMCSNGSLQCRICI

SEQ ID NO: 2660 - protein, 566 aa, Artificial Sequence
  hemagglutinin__InfluenzaA__ACP44236
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSDKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2661 - protein, 566 aa, Artificial Sequence; identical to SEQ ID NO: 2597
  hemagglutinin__InfluenzaA__ACP44247

SEQ ID NO: 2662 - protein, 566 aa, Artificial Sequence; identical to SEQ ID NO: 630
  hemagglutinin__InfluenzaA__ACP44258

SEQ ID NO: 2663 - protein, 566 aa, Artificial Sequence; identical to SEQ ID NO: 630
  hemagglutinin__InfluenzaA__ACP44269

SEQ ID NO: 2664 - protein, 566 aa, Artificial Sequence; identical to SEQ ID NO: 2656
  hemagglutinin__InfluenzaA__ACQ44554

SEQ ID NO: 2665 - protein, 566 aa, Artificial Sequence; identical to SEQ ID NO: 2656
  hemagglutinin__InfluenzaA__ACQ44556

SEQ ID NO: 2666 - protein, 566 aa, Artificial Sequence; identical to SEQ ID NO: 2656
  hemagglutinin__InfluenzaA__ACQ45338

SEQ ID NO: 2667 - protein, 566 aa, Artificial Sequence
  hemagglutinin__InfluenzaA__ACQ55359
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2668 - protein, 566 aa, Artificial Sequence; identical to SEQ ID NO: 2656
  hemagglutinin__InfluenzaA__ACQ55361

SEQ ID NO: 2669 - protein, 566 aa, Artificial Sequence
  hemagglutinin__InfluenzaA__ACQ63223
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2670 - protein, 566 aa, Artificial Sequence; identical to SEQ ID NO: 2669
  hemagglutinin__InfluenzaA__ACQ63239

SEQ ID NO: 2671 - protein, 566 aa, Artificial Sequence; identical to SEQ ID NO: 2669
  hemagglutinin__InfluenzaA__ACQ63244

SEQ ID NO: 2672 - protein, 566 aa, Artificial Sequence; identical to SEQ ID NO: 2669
  hemagglutinin__InfluenzaA__ACQ63257

SEQ ID NO: 2673 - protein, 566 aa, Artificial Sequence
  hemagglutinin__InfluenzaA__ACQ65691
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSSCKRGSDNSFFSRLNWLTHLKFKYPALNVTMPNNEKFDKLYIWGVHHPGTDNDQIFPYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFTISCFLLCVALLGFIMWACQKGNIRCNICI

SEQ ID NO: 2674 - protein, 566 aa, Artificial Sequence; identical to SEQ ID NO: 2434
  hemagglutinin__InfluenzaA__ACQ65713

SEQ ID NO: 2675 - protein, 566 aa, Artificial Sequence
  hemagglutinin__InfluenzaA__ACQ65724
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWAGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2676 - protein, 566 aa, Artificial Sequence
  hemagglutinin__InfluenzaA__ACQ65747
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRTNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGIGQAADLKSTQAAIDQINGKLNGLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2677 - protein, 565 aa, Artificial Sequence
  hemagglutinin__InfluenzaA__ACQ65758
MKVKLLVLLCTFTATYADTICIGYHANNSTDTVDTVLEKNVTVTHSVNLLENSHNGKLCLLKGIAPLQLGNCSVAGWILGNPECELLISKESWSYVVEKPNPENGTCYPGHFADYEELREQLSSVSSFERFEIFPKESSWPNHTVTGVSASCSHNGESSFYRNLLWLTGKNGLYPNLSKSYANNKGKEVLVLWGVHHPPNIGDQNTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2678 - protein, 566 aa, Artificial Sequence; identical to SEQ ID NO: 2656
  hemagglutinin__InfluenzaA__ACQ73386

SEQ ID NO: 2679 - protein, 566 aa, Artificial Sequence; identical to SEQ ID NO: 2669
  hemagglutinin__InfluenzaA__ACQ73387

SEQ ID NO: 2680 - protein, 566 aa, Artificial Sequence
  hemagglutinin__InfluenzaA__ACQ73555
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTKPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2681 - protein, 566 aa, Artificial Sequence; identical to SEQ ID NO: 2669
  hemagglutinin__InfluenzaA__ACQ76294

SEQ ID NO: 2682 - protein, 566 aa, Artificial Sequence; identical to SEQ ID NO: 2669
  hemagglutinin__InfluenzaA__ACQ76314

SEQ ID NO: 2683 - protein, 566 aa, Artificial Sequence; identical to SEQ ID NO: 2669
  hemagglutinin__InfluenzaA__ACQ76317

SEQ ID NO: 2684 - protein, 566 aa, Artificial Sequence
  hemagglutinin__InfluenzaA__ACQ76318
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2685 - protein, 566 aa, Artificial Sequence; identical to SEQ ID NO: 2656
  hemagglutinin__InfluenzaA__ACQ76326

SEQ ID NO: 2686 - protein, 566 aa, Artificial Sequence; identical to SEQ ID NO: 2656
  hemagglutinin__InfluenzaA__ACQ76336

SEQ ID NO: 2687 - protein, 566 aa, Artificial Sequence; identical to SEQ ID NO: 2656
  hemagglutinin__InfluenzaA__ACQ76347

SEQ ID NO: 2688 - protein, 566 aa, Artificial Sequence; identical to SEQ ID NO: 2669
  hemagglutinin__InfluenzaA__ACQ76365

SEQ ID NO: 2689 - protein, 566 aa, Artificial Sequence; identical to SEQ ID NO: 2669
  hemagglutinin__InfluenzaA__ACQ76370

SEQ ID NO: 2690 - protein, 566 aa, Artificial Sequence; identical to SEQ ID NO: 2656
  hemagglutinin__InfluenzaA__ACQ76376

SEQ ID NO: 2691 - protein, 566 aa, Artificial Sequence
  hemagglutinin__InfluenzaA__ACQ76383
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2692 - protein, 566 aa, Artificial Sequence; identical to SEQ ID NO: 2669
  hemagglutinin__InfluenzaA__ACQ76389

SEQ ID NO: 2693 - protein, 566 aa, Artificial Sequence; identical to SEQ ID NO: 2656
  hemagglutinin__InfluenzaA__ACQ76401

SEQ ID NO: 2694 - protein, 566 aa, Artificial Sequence; identical to SEQ ID NO: 2669
  hemagglutinin__InfluenzaA__ACQ76405

SEQ ID NO: 2695 - protein, 566 aa, Artificial Sequence
  hemagglutinin__InfluenzaA__ACQ76408
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2696 - protein, 566 aa, Artificial Sequence
  hemagglutinin__InfluenzaA__ACQ77601
MKTIIALSYILCLAFAQKLPGNDNSTATLCLGHHAVPNGTLVKTITNDQIEVTNATELVQSSSTGRICDSPHQILDGENCTLIDALLGDPHCDGFQNKEWDLFVERSKAYSDCYPYDVPDYASLRSLVASSGTLEFNNESFNWTGVAQNGTSSACKRRSIKSFFSRLNWLHQLENRYPAPNVTMPNNDKFDKLYIWGVHHPSTDSDQISVYAQASGRVTVSTKRSQQTVIPNIGSRPWVRGISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNKLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2697 - protein, 566 aa, Artificial Sequence
  hemagglutinin__InfluenzaA__ACQ83310
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSMSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKLKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2698 - protein, 566 aa, Artificial Sequence; identical to SEQ ID NO: 2656
  hemagglutinin__InfluenzaA__ACQ84451

SEQ ID NO: 2699 - protein, 566 aa, Artificial Sequence; identical to SEQ ID NO: 2656
  hemagglutinin__InfluenzaA__ACQ84457

SEQ ID NO: 2700 - protein, 566 aa, Artificial Sequence
  hemagglutinin__InfluenzaA__ACQ84477
MKAILLVLLYTFTAANADTLCIGYHANNSTDTVDTVLEKNVTVTHSVNLLEDRHNGKLCKLRGVAPLHLGKCNIAGWLLGNPECELLFTASSWSYIVETSNSDNGTCYPGDFINYEELREQLSSVSSFERFEIFPKASSWPDHETNRGVTAACPYAGANSFYRNLIWLVKKGNSYPKLSKSYVNNKEKEVLVLWGIHHPPTSTDQQSLYQNADAYVFVGSSKYNKKFKPEIATRPKVRGQAGRMNYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADQKSTQNAIDGITNKVNSVIEKMNTQFTAVGKEFNHLEKRIENLNKKVDDGFLDVWTYNAELLVLLENERTLDYHDSNVKNLYEKVRSQLKNNAKEIGNGCFEFYHKCDDTCMESVKNGTYDYPKYSEESKLNREEIDGVKLESTRIYQILAIYSTVASSLVLLVSLGAISFWMCSNGSLQCRICI

SEQ ID NO: 2701 - protein, 566 aa, Artificial Sequence
  hemagglutinin__InfluenzaA__ACQ89900
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVVEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2702 - protein, 566 aa, Artificial Sequence; identical to SEQ ID NO: 2669
  hemagglutinin__InfluenzaA__ACQ89902

SEQ ID NO: 2703 - protein, 566 aa, Artificial Sequence
  hemagglutinin__InfluenzaA__ACQ89904
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDKGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2704 - protein, 566 aa, Artificial Sequence; identical to SEQ ID NO: 2701
  hemagglutinin__InfluenzaA__ACQ89905

SEQ ID NO: 2705 - protein, 566 aa, Artificial Sequence; identical to SEQ ID NO: 2656
  hemagglutinin__InfluenzaA__ACQ99607

SEQ ID NO: 2706 - protein, 566 aa, Artificial Sequence; identical to SEQ ID NO: 2656
  hemagglutinin__InfluenzaA__ACQ99608

SEQ ID NO: 2707 - protein, 566 aa, Artificial Sequence; identical to SEQ ID NO: 2656
  hemagglutinin__InfluenzaA__ACQ99609

SEQ ID NO: 2708 - protein, 566 aa, Artificial Sequence; identical to SEQ ID NO: 2656
  hemagglutinin__InfluenzaA__ACQ99611

SEQ ID NO: 2709 - protein, 566 aa, Artificial Sequence
  hemagglutinin__InfluenzaA__ACQ99614
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLILLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2710 - protein, 566 aa, Artificial Sequence; identical to SEQ ID NO: 2709
  hemagglutinin__InfluenzaA__ACQ99616

SEQ ID NO: 2711 - protein, 566 aa, Artificial Sequence; identical to SEQ ID NO: 2656
  hemagglutinin__InfluenzaA__ACQ99617

SEQ ID NO: 2712 - protein, 566 aa, Artificial Sequence; identical to SEQ ID NO: 2656
  hemagglutinin__InfluenzaA__ACQ99618

SEQ ID NO: 2713 - protein, 566 aa, Artificial Sequence; identical to SEQ ID NO: 2656
  hemagglutinin__InfluenzaA__ACQ99619

SEQ ID NO: 2714 - protein, 566 aa, Artificial Sequence; identical to SEQ ID NO: 2656
  hemagglutinin__InfluenzaA__ACQ99620

SEQ ID NO: 2715 - protein, 566 aa, Artificial Sequence; identical to SEQ ID NO: 2709
  hemagglutinin__InfluenzaA__ACQ99621

SEQ ID NO: 2716 - protein, 566 aa, Artificial Sequence; identical to SEQ ID NO: 2656
  hemagglutinin__InfluenzaA__ACQ99622

SEQ ID NO: 2717 - protein, 566 aa, Artificial Sequence
  hemagglutinin__InfluenzaA__ACR01014
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRMENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2718 - protein, 566 aa, Artificial Sequence; identical to SEQ ID NO: 2669
  hemagglutinin__InfluenzaA__ACR08419

SEQ ID NO: 2719 - protein, 566 aa, Artificial Sequence
  hemagglutinin__InfluenzaA__ACR08429
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNTGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2720 - protein, 566 aa, Artificial Sequence; identical to SEQ ID NO: 2669
  hemagglutinin__InfluenzaA__ACR08439

SEQ ID NO: 2721 - protein, 566 aa, Artificial Sequence; identical to SEQ ID NO: 2669
  hemagglutinin__InfluenzaA__ACR08449

SEQ ID NO: 2722 - protein, 566 aa, Artificial Sequence
  hemagglutinin__InfluenzaA__ACR08459
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCDTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2723 - protein, 566 aa, Artificial Sequence; identical to SEQ ID NO: 2656
  hemagglutinin__InfluenzaA__ACR08528

SEQ ID NO: 2724 - protein, 566 aa, Artificial Sequence; identical to SEQ ID NO: 2656
  hemagglutinin__InfluenzaA__ACR08530

SEQ ID NO: 2725 - protein, 566 aa, Artificial Sequence; identical to SEQ ID NO: 2722
  hemagglutinin__InfluenzaA__ACR08531

SEQ ID NO: 2726 - protein, 566 aa, Artificial Sequence; identical to SEQ ID NO: 2669
  hemagglutinin__InfluenzaA__ACR08533

SEQ ID NO: 2727 - protein, 566 aa, Artificial Sequence; identical to SEQ ID NO: 2722
  hemagglutinin__InfluenzaA__ACR08535

SEQ ID NO: 2728 - protein, 566 aa, Artificial Sequence; identical to SEQ ID NO: 2669
  hemagglutinin__InfluenzaA__ACR08536

SEQ ID NO: 2729 - protein, 566 aa, Artificial Sequence; identical to SEQ ID NO: 2722
  hemagglutinin__InfluenzaA__ACR08537

SEQ ID NO: 2730 - protein, 566 aa, Artificial Sequence; identical to SEQ ID NO: 2722
  hemagglutinin__InfluenzaA__ACR08538

SEQ ID NO: 2731 - protein, 566 aa, Artificial Sequence; identical to SEQ ID NO: 2669
  hemagglutinin__InfluenzaA__ACR08539

SEQ ID NO: 2732 - protein, 566 aa, Artificial Sequence; identical to SEQ ID NO: 2669
  hemagglutinin__InfluenzaA__ACR08540

SEQ ID NO: 2733 - protein, 566 aa, Artificial Sequence; identical to SEQ ID NO: 2656
  hemagglutinin__InfluenzaA__ACR08542

SEQ ID NO: 2734 - protein, 566 aa, Artificial Sequence; identical to SEQ ID NO: 2656
  hemagglutinin__InfluenzaA__ACR08543

SEQ ID NO: 2735 - protein, 566 aa, Artificial Sequence; identical to SEQ ID NO: 2695
  hemagglutinin__InfluenzaA__ACR08544

SEQ ID NO: 2736 - protein, 566 aa, Artificial Sequence; identical to SEQ ID NO: 2722
  hemagglutinin__InfluenzaA__ACR08545

SEQ ID NO: 2737 - protein, 566 aa, Artificial Sequence; identical to SEQ ID NO: 2656
  hemagglutinin__InfluenzaA__ACR08546

SEQ ID NO: 2738 - protein, 566 aa, Artificial Sequence; identical to SEQ ID NO: 2669
  hemagglutinin__InfluenzaA__ACR08547

SEQ ID NO: 2739 - protein, 566 aa, Artificial Sequence; identical to SEQ ID NO: 2722
  hemagglutinin__InfluenzaA__ACR08548

SEQ ID NO: 2740 - protein, 566 aa, Artificial Sequence; identical to SEQ ID NO: 2669
  hemagglutinin__InfluenzaA__ACR08549

SEQ ID NO: 2741 - protein, 566 aa, Artificial Sequence; identical to SEQ ID NO: 2669
  hemagglutinin__InfluenzaA__ACR08550

SEQ ID NO: 2742 - protein, 566 aa, Artificial Sequence; identical to SEQ ID NO: 2669
  hemagglutinin__InfluenzaA__ACR08551

SEQ ID NO: 2743 - protein, 566 aa, Artificial Sequence; identical to SEQ ID NO: 2656
  hemagglutinin__InfluenzaA__ACR08552

SEQ ID NO: 2744 - protein, 566 aa, Artificial Sequence; identical to SEQ ID NO: 2695
  hemagglutinin__InfluenzaA__ACR08553

SEQ ID NO: 2745 - protein, 566 aa, Artificial Sequence; identical to SEQ ID NO: 2695
  hemagglutinin__InfluenzaA__ACR08554

SEQ ID NO: 2746 - protein, 566 aa, Artificial Sequence; identical to SEQ ID NO: 2656
  hemagglutinin__InfluenzaA__ACR09365

SEQ ID NO: 2747 - protein, 566 aa, Artificial Sequence; identical to SEQ ID NO: 2656
  hemagglutinin__InfluenzaA__ACR09366

SEQ ID NO: 2748 - protein, 566 aa, Artificial Sequence; identical to SEQ ID NO: 2656
  hemagglutinin__InfluenzaA__ACR09367

SEQ ID NO: 2749 - protein, 566 aa, Artificial Sequence; identical to SEQ ID NO: 2656
  hemagglutinin__InfluenzaA__ACR09368

SEQ ID NO: 2750 - protein, 566 aa, Artificial Sequence; identical to SEQ ID NO: 2656
  hemagglutinin__InfluenzaA__ACR09369

SEQ ID NO: 2751 - protein, 566 aa, Artificial Sequence; identical to SEQ ID NO: 2656
  hemagglutinin__InfluenzaA__ACR09370

SEQ ID NO: 2752 - protein, 566 aa, Artificial Sequence; identical to SEQ ID NO: 2656
  hemagglutinin__InfluenzaA__ACR09371

SEQ ID NO: 2753 - protein, 566 aa, Artificial Sequence; identical to SEQ ID NO: 2656
  hemagglutinin__InfluenzaA__ACR09373

SEQ ID NO: 2754 - protein, 566 aa, Artificial Sequence; identical to SEQ ID NO: 2656
  hemagglutinin__InfluenzaA__ACR09374

SEQ ID NO: 2755 - protein, 566 aa, Artificial Sequence
  hemagglutinin__InfluenzaA__ACR09375
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2756 - protein, 566 aa, Artificial Sequence; identical to SEQ ID NO: 2656
  hemagglutinin__InfluenzaA__ACR09376

SEQ ID NO: 2757 - protein, 566 aa, Artificial Sequence; identical to SEQ ID NO: 2656
  hemagglutinin__InfluenzaA__ACR09377

SEQ ID NO: 2758 - protein, 566 aa, Artificial Sequence; identical to SEQ ID NO: 2656
  hemagglutinin__InfluenzaA__ACR09395

SEQ ID NO: 2759 - protein, 566 aa, Artificial Sequence; identical to SEQ ID NO: 2656
  hemagglutinin__InfluenzaA__ACR09396

SEQ ID NO: 2760 - protein, 566 aa, Artificial Sequence
  hemagglutinin__InfluenzaA__ACR10186
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2761 - protein, 566 aa, Artificial Sequence; identical to SEQ ID NO: 2760
  hemagglutinin__InfluenzaA__ACR10222

SEQ ID NO: 2762 - protein, 566 aa, Artificial Sequence
  hemagglutinin__InfluenzaA__ACR10223
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2763 - protein, 566 aa, Artificial Sequence
  hemagglutinin__InfluenzaA__ACR15183
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRGSDNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2764 - protein, 565 aa, Artificial Sequence
  hemagglutinin__InfluenzaA__ACR15194
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGLGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNRCFEFYHKCNDECMESVKNGTYDYPKYSEESKLNREKIDGVKLESMGVYQILAIYSTVASSLVLLVSLGAISFWMCSNGSLQCRICI

SEQ ID NO: 2765 - protein, 565 aa, Artificial Sequence; identical to SEQ ID NO: 870
  hemagglutinin__InfluenzaA__ACR15216

SEQ ID NO: 2766 - protein, 566 aa, Artificial Sequence
  hemagglutinin__InfluenzaA__ACR15227
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACQRRSNKSFFSRLNWLTHLKFKYPALNVTMPNNEKFDKLYIWGVHHPGTDNDQISLYAQTSGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPERQTRGIFGAIAGFIENGWEGMMDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2767 - protein, 565 aa, Artificial Sequence
  hemagglutinin__InfluenzaA__ACR15238
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGVQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYQHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2768 - protein, 566 aa, Artificial Sequence
  hemagglutinin__InfluenzaA__ACR15249
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2769 - protein, 566 aa, Artificial Sequence
  hemagglutinin__InfluenzaA__ACR15282
MKTIIALSYILCLVFAQKLPGNDNSTATLCLGHHAVPNGTIVKTIMNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2770 - protein, 566 aa, Artificial Sequence
  hemagglutinin__InfluenzaA__ACR15293
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNENFNWTGVTQNGTSSACKRGSDNSFFSRLNWLTHLKFKYPALKVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2771 - protein, 565 aa, Artificial Sequence
  hemagglutinin__InfluenzaA__ACR15304
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNTGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNRLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2772 - protein, 565 aa, Artificial Sequence
  hemagglutinin__InfluenzaA__ACR15315
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIRDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2773 - protein, 565 aa, Artificial Sequence
  hemagglutinin__InfluenzaA__ACR15326
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMGECDEKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 2774 - protein, 565 aa, Artificial Sequence
  hemagglutinin__InfluenzaA__ACR15359
MKVKLLVLLCTFTATYADTICIGYHANNSTDTVDTVLEKNVTVTHSVNLLENSHNGKLCLLKGIAPLQLGNCSVAGWILGNPECGLLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2775 - protein, 565 aa, Artificial Sequence
  hemagglutinin__InfluenzaA__ACR15370
MKVKLLVLLCTLTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLILLVSLGAISFWMCSNGSLQCRICI

SEQ ID NO: 2776 - protein, 566 aa, Artificial Sequence; identical to SEQ ID NO: 2301
  hemagglutinin__InfluenzaA__ACR15381

SEQ ID NO: 2777 - protein, 566 aa, Artificial Sequence; identical to SEQ ID NO: 2308
  hemagglutinin__InfluenzaA__ACR15392

SEQ ID NO: 2778 - protein, 566 aa, Artificial Sequence; identical to SEQ ID NO: 1928
  hemagglutinin__InfluenzaA__ACR15403

SEQ ID NO: 2779 - protein, 566 aa, Artificial Sequence; identical to SEQ ID NO: 1928
  hemagglutinin__InfluenzaA__ACR15414

SEQ ID NO: 2780 - protein, 565 aa, Artificial Sequence; identical to SEQ ID NO: 2774
  hemagglutinin__InfluenzaA__ACR15425

SEQ ID NO: 2781 - protein, 565 aa, Artificial Sequence
  hemagglutinin__InfluenzaA__ACR15436
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKGKEVLVLWGVHHPPNIGDQNTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2782 - protein, 565 aa, Artificial Sequence
  hemagglutinin__InfluenzaA__ACR15458
MKVKLLVLLCTFTATYADTICIGYHANNSTDTVDTVLEKNVTVTHSVNLLENSHNGKLCLLKGIAPLQLGNCSVAGWILGNPECELLISKESWSYIVENPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2783 - protein, 565 aa, Artificial Sequence
  hemagglutinin__InfluenzaA__ACR15469
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPDPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQNTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2784 - protein, 565 aa, Artificial Sequence; identical to SEQ ID NO: 2781
  hemagglutinin__InfluenzaA__ACR15480

SEQ ID NO: 2785 - protein, 565 aa, Artificial Sequence
  hemagglutinin__InfluenzaA__ACR15491
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGRNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGIKLESMGVYQILAIYSTVASSLVLLVSLGAISFWMCSNGSLQCRICI

SEQ ID NO: 2786 - protein, 565 aa, Artificial Sequence
  hemagglutinin__InfluenzaA__ACR15502
MKVKLLVLLCTFTATYADTICIGYHANNATDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKGKEVLVLWGVHHPPNIGDQNTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2787 - protein, 565 aa, Artificial Sequence; identical to SEQ ID NO: 2643
  hemagglutinin__InfluenzaA__ACR15513

SEQ ID NO: 2788 - protein, 566 aa, Artificial Sequence
  hemagglutinin__InfluenzaA__ACR15524
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKSGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 2789 - protein, 566 aa, Artificial Sequence; identical to SEQ ID NO: 2597
  hemagglutinin__InfluenzaA__ACR15535

SEQ ID NO: 2790 - protein, 566 aa, Artificial Sequence
  hemagglutinin__InfluenzaA__ACR15546
MKTIIALSYILCLVFAQKLPGNDNSTATLCLGHHAVPNGTIVKTITNDQIEVTNATELVQSSSTGGICDSPHHILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNETYDHDVYRDEALNNRFQIKGVELKSGYKDWILWISFAISCFLLCVALLGFIMWACQKGNIRCNICI

SEQ ID NO: 2791 - protein, 566 aa, Artificial Sequence; identical to SEQ ID NO: 2372
  hemagglutinin__InfluenzaA__ACR15557

SEQ ID NO: 2792 - protein, 566 aa, Artificial Sequence; identical to SEQ ID NO: 630
  hemagglutinin__InfluenzaA__ACR15568

SEQ ID NO: 2793 - protein, 566 aa, Artificial Sequence
  hemagglutinin__InfluenzaA__ACR15579
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVNPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2794 - protein, 566 aa, Artificial Sequence
  hemagglutinin__InfluenzaA__ACR15590
MKTIIALSYILCLVFTQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 2795 - protein, 566 aa, Artificial Sequence; identical to SEQ ID NO: 630
  hemagglutinin__InfluenzaA__ACR15601

SEQ ID NO: 2796 - protein, 566 aa, Artificial Sequence
  hemagglutinin__InfluenzaA__ACR18920
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNIQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2797 - protein, 566 aa, Artificial Sequence; identical to SEQ ID NO: 2669
  hemagglutinin__InfluenzaA__ACR18975

SEQ ID NO: 2798 - protein, 566 aa, Artificial Sequence; identical to SEQ ID NO: 2656
  hemagglutinin__InfluenzaA__ACR18976

SEQ ID NO: 2799 - protein, 566 aa, Artificial Sequence; identical to SEQ ID NO: 2656
  hemagglutinin__InfluenzaA__ACR18977

SEQ ID NO: 2800 - protein, 566 aa, Artificial Sequence; identical to SEQ ID NO: 2669
  hemagglutinin__InfluenzaA__ACR18978

SEQ ID NO: 2801 - protein, 566 aa, Artificial Sequence; identical to SEQ ID NO: 2656
  hemagglutinin__InfluenzaA__ACR18979

SEQ ID NO: 2802 - protein, 566 aa, Artificial Sequence; identical to SEQ ID NO: 2722
  hemagglutinin__InfluenzaA__ACR18981

SEQ ID NO: 2803 - protein, 566 aa, Artificial Sequence; identical to SEQ ID NO: 2656
  hemagglutinin__InfluenzaA__ACR18982

SEQ ID NO: 2804 - protein, 566 aa, Artificial Sequence; identical to SEQ ID NO: 2669
  hemagglutinin__InfluenzaA__ACR18988

SEQ ID NO: 2805 - protein, 566 aa, Artificial Sequence
  hemagglutinin__InfluenzaA__ACR18991
MKAILVVLLYTFATANADTLCIGYHANNSTDTVDTVLEKNVTVTHSVNLLEDKHNRKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2806 - protein, 566 aa, Artificial Sequence; identical to SEQ ID NO: 2656
  hemagglutinin__InfluenzaA__ACR18993

SEQ ID NO: 2807 - protein, 566 aa, Artificial Sequence; identical to SEQ ID NO: 2695
  hemagglutinin__InfluenzaA__ACR18995

SEQ ID NO: 2808 - protein, 566 aa, Artificial Sequence; identical to SEQ ID NO: 2717
  hemagglutinin__InfluenzaA__ACR23302

SEQ ID NO: 2809 - protein, 566 aa, Artificial Sequence; identical to SEQ ID NO: 2669
  hemagglutinin__InfluenzaA__ACR33743

SEQ ID NO: 2810 - protein, 566 aa, Artificial Sequence; identical to SEQ ID NO: 2656
  hemagglutinin__InfluenzaA__ACR38821

SEQ ID NO: 2811 - protein, 566 aa, Artificial Sequence; identical to SEQ ID NO: 2656
  hemagglutinin__InfluenzaA__ACR38822

SEQ ID NO: 2812 - protein, 566 aa, Artificial Sequence; identical to SEQ ID NO: 2656
  hemagglutinin__InfluenzaA__ACR38823

SEQ ID NO: 2813 - protein, 566 aa, Artificial Sequence; identical to SEQ ID NO: 2722
  hemagglutinin__InfluenzaA__ACR38824

SEQ ID NO: 2814 - protein, 566 aa, Artificial Sequence
  hemagglutinin__InfluenzaA__ACR38825
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2815 - protein, 566 aa, Artificial Sequence; identical to SEQ ID NO: 2669
  hemagglutinin__InfluenzaA__ACR38826

SEQ ID NO: 2816 - protein, 566 aa, Artificial Sequence; identical to SEQ ID NO: 2656
  hemagglutinin__InfluenzaA__ACR38827

SEQ ID NO: 2817 - protein, 566 aa, Artificial Sequence; identical to SEQ ID NO: 2722
  hemagglutinin__InfluenzaA__ACR38828

SEQ ID NO: 2818 - protein, 566 aa, Artificial Sequence; identical to SEQ ID NO: 2656
  hemagglutinin__InfluenzaA__ACR38829

SEQ ID NO: 2819 - protein, 566 aa, Artificial Sequence; identical to SEQ ID NO: 2695
  hemagglutinin__InfluenzaA__ACR38830

SEQ ID NO: 2820 - protein, 566 aa, Artificial Sequence; identical to SEQ ID NO: 2669
  hemagglutinin__InfluenzaA__ACR39354

SEQ ID NO: 2821 - protein, 566 aa, Artificial Sequence; identical to SEQ ID NO: 2669
  hemagglutinin__InfluenzaA__ACR39393

SEQ ID NO: 2822 - protein, 566 aa, Artificial Sequence; identical to SEQ ID NO: 2669
  hemagglutinin__InfluenzaA__ACR39403

SEQ ID NO: 2823 - protein, 566 aa, Artificial Sequence; identical to SEQ ID NO: 2669
  hemagglutinin__InfluenzaA__ACR39413

SEQ ID NO: 2824 - protein, 566 aa, Artificial Sequence; identical to SEQ ID NO: 2669
  hemagglutinin__InfluenzaA__ACR39423

SEQ ID NO: 2825 - protein, 566 aa, Artificial Sequence; identical to SEQ ID NO: 2669
  hemagglutinin__InfluenzaA__ACR39433

SEQ ID NO: 2826 - protein, 566 aa, Artificial Sequence; identical to SEQ ID NO: 2669
  hemagglutinin__InfluenzaA__ACR39443

SEQ ID NO: 2827 - protein, 566 aa, Artificial Sequence
  hemagglutinin__InfluenzaA__ACR39453
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2828 - protein, 566 aa, Artificial Sequence; identical to SEQ ID NO: 2669
  hemagglutinin__InfluenzaA__ACR39463

SEQ ID NO: 2829 - protein, 566 aa, Artificial Sequence; identical to SEQ ID NO: 2669
  hemagglutinin__InfluenzaA__ACR39473

SEQ ID NO: 2830 - protein, 566 aa, Artificial Sequence; identical to SEQ ID NO: 2669
  hemagglutinin__InfluenzaA__ACR39483

SEQ ID NO: 2831 - protein, 566 aa, Artificial Sequence; identical to SEQ ID NO: 2669
  hemagglutinin__InfluenzaA__ACR39493

SEQ ID NO: 2832 - protein, 566 aa, Artificial Sequence; identical to SEQ ID NO: 2669
  hemagglutinin__InfluenzaA__ACR40288

SEQ ID NO: 2833 - protein, 566 aa, Artificial Sequence; identical to SEQ ID NO: 2669
  hemagglutinin__InfluenzaA__ACR40298

SEQ ID NO: 2834 - protein, 566 aa, Artificial Sequence
  hemagglutinin__InfluenzaA__ACR40308
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIYPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2835 - protein, 566 aa, Artificial Sequence; identical to SEQ ID NO: 2669
  hemagglutinin__InfluenzaA__ACR40318

SEQ ID NO: 2836 - protein, 566 aa, Artificial Sequence; identical to SEQ ID NO: 2669
  hemagglutinin__InfluenzaA__ACR40328

SEQ ID NO: 2837 - protein, 566 aa, Artificial Sequence; identical to SEQ ID NO: 2669
  hemagglutinin__InfluenzaA__ACR40338

SEQ ID NO: 2838 - protein, 566 aa, Artificial Sequence; identical to SEQ ID NO: 2669
  hemagglutinin__InfluenzaA__ACR40348

SEQ ID NO: 2839 - protein, 566 aa, Artificial Sequence; identical to SEQ ID NO: 2669
  hemagglutinin__InfluenzaA__ACR40358

SEQ ID NO: 2840 - protein, 566 aa, Artificial Sequence; identical to SEQ ID NO: 2669
  hemagglutinin__InfluenzaA__ACR40378

SEQ ID NO: 2841 - protein, 566 aa, Artificial Sequence; identical to SEQ ID NO: 2669
  hemagglutinin__InfluenzaA__ACR40388

SEQ ID NO: 2842 - protein, 566 aa, Artificial Sequence; identical to SEQ ID NO: 2656
  hemagglutinin__InfluenzaA__ACR46986

SEQ ID NO: 2843 - protein, 566 aa, Artificial Sequence; identical to SEQ ID NO: 2656
  hemagglutinin__InfluenzaA__ACR46988

SEQ ID NO: 2844 - protein, 566 aa, Artificial Sequence; identical to SEQ ID NO: 2656
  hemagglutinin__InfluenzaA__ACR46989

SEQ ID NO: 2845 - protein, 566 aa, Artificial Sequence; identical to SEQ ID NO: 2656
  hemagglutinin__InfluenzaA__ACR46990

SEQ ID NO: 2846 - protein, 566 aa, Artificial Sequence; identical to SEQ ID NO: 2656
  hemagglutinin__InfluenzaA__ACR46992

SEQ ID NO: 2847 - protein, 566 aa, Artificial Sequence; identical to SEQ ID NO: 2656
  hemagglutinin__InfluenzaA__ACR46993

SEQ ID NO: 2848 - protein, 566 aa, Artificial Sequence; identical to SEQ ID NO: 2656
  hemagglutinin__InfluenzaA__ACR46994

SEQ ID NO: 2849 - protein, 566 aa, Artificial Sequence
  hemagglutinin__InfluenzaA__ACR47006
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2850 - protein, 566 aa, Artificial Sequence; identical to SEQ ID NO: 2669
  hemagglutinin__InfluenzaA__ACR49281

SEQ ID NO: 2851 - protein, 566 aa, Artificial Sequence
  hemagglutinin__InfluenzaA__ACR49282
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2852 - protein, 566 aa, Artificial Sequence; identical to SEQ ID NO: 2656
  hemagglutinin__InfluenzaA__ACR49283

SEQ ID NO: 2853 - protein, 566 aa, Artificial Sequence; identical to SEQ ID NO: 2656
  hemagglutinin__InfluenzaA__ACR49288

SEQ ID NO: 2854 - protein, 566 aa, Artificial Sequence; identical to SEQ ID NO: 2695
  hemagglutinin__InfluenzaA__ACR49290

SEQ ID NO: 2855 - protein, 566 aa, Artificial Sequence; identical to SEQ ID NO: 2669
  hemagglutinin__InfluenzaA__ACR49291

SEQ ID NO: 2856 - protein, 566 aa, Artificial Sequence; identical to SEQ ID NO: 2695
  hemagglutinin__InfluenzaA__ACR49293

SEQ ID NO: 2857 - protein, 566 aa, Artificial Sequence; identical to SEQ ID NO: 2695
  hemagglutinin__InfluenzaA__ACR49295

SEQ ID NO: 2858 - protein, 566 aa, Artificial Sequence; identical to SEQ ID NO: 2709
  hemagglutinin__InfluenzaA__ACR50993

SEQ ID NO: 2859 - protein, 566 aa, Artificial Sequence; identical to SEQ ID NO: 2669
  hemagglutinin__InfluenzaA__ACR50995

SEQ ID NO: 2860 - protein, 566 aa, Artificial Sequence; identical to SEQ ID NO: 2669
  hemagglutinin__InfluenzaA__ACR51005

SEQ ID NO: 2861 - protein, 566 aa, Artificial Sequence; identical to SEQ ID NO: 2669
  hemagglutinin__InfluenzaA__ACR51015

SEQ ID NO: 2862 - protein, 566 aa, Artificial Sequence; identical to SEQ ID NO: 2669
  hemagglutinin__InfluenzaA__ACR51025

SEQ ID NO: 2863 - protein, 566 aa, Artificial Sequence; identical to SEQ ID NO: 2669
  hemagglutinin__InfluenzaA__ACR51035

SEQ ID NO: 2864 - protein, 566 aa, Artificial Sequence; identical to SEQ ID NO: 2669
  hemagglutinin__InfluenzaA__ACR51045

SEQ ID NO: 2865 - protein, 566 aa, Artificial Sequence; identical to SEQ ID NO: 2669
  hemagglutinin__InfluenzaA__ACR51055

SEQ ID NO: 2866 - protein, 566 aa, Artificial Sequence; identical to SEQ ID NO: 2656
  hemagglutinin__InfluenzaA__ACR51065

SEQ ID NO: 2867 - protein, 566 aa, Artificial Sequence; identical to SEQ ID NO: 2669
  hemagglutinin__InfluenzaA__ACR52368

SEQ ID NO: 2868 - protein, 566 aa, Artificial Sequence; identical to SEQ ID NO: 2669
  hemagglutinin__InfluenzaA__ACR52378

SEQ ID NO: 2869 - protein, 566 aa, Artificial Sequence; identical to SEQ ID NO: 2669
  hemagglutinin__InfluenzaA__ACR52398

SEQ ID NO: 2870 - protein, 566 aa, Artificial Sequence; identical to SEQ ID NO: 2669
  hemagglutinin__InfluenzaA__ACR52408

SEQ ID NO: 2871 - protein, 566 aa, Artificial Sequence; identical to SEQ ID NO: 2669
  hemagglutinin__InfluenzaA__ACR52418

SEQ ID NO: 2872 - protein, 566 aa, Artificial Sequence; identical to SEQ ID NO: 2669
  hemagglutinin__InfluenzaA__ACR52428

SEQ ID NO: 2873 - protein, 566 aa, Artificial Sequence; identical to SEQ ID NO: 2669
  hemagglutinin__InfluenzaA__ACR52438

SEQ ID NO: 2874 - protein, 566 aa, Artificial Sequence; identical to SEQ ID NO: 2669
  hemagglutinin__InfluenzaA__ACR52448

SEQ ID NO: 2875 - protein, 566 aa, Artificial Sequence; identical to SEQ ID NO: 2669
  hemagglutinin__InfluenzaA__ACR52458

SEQ ID NO: 2876 - protein, 566 aa, Artificial Sequence; identical to SEQ ID NO: 2669
  hemagglutinin__InfluenzaA__ACR52468

SEQ ID NO: 2877 - protein, 566 aa, Artificial Sequence; identical to SEQ ID NO: 2669
  hemagglutinin__InfluenzaA__ACR52478

SEQ ID NO: 2878 - protein, 566 aa, Artificial Sequence; identical to SEQ ID NO: 2669
  hemagglutinin__InfluenzaA__ACR52488

SEQ ID NO: 2879 - protein, 566 aa, Artificial Sequence; identical to SEQ ID NO: 2669
  hemagglutinin__InfluenzaA__ACR54045

SEQ ID NO: 2880 - protein, 566 aa, Artificial Sequence
  hemagglutinin__InfluenzaA__ACR54047
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGIKLESTRIYQILAIYSTVASSLVLVVSLGAISFWMCSNGSLQCRICI

SEQ ID NO: 2881 - protein, 566 aa, Artificial Sequence
  hemagglutinin__InfluenzaA__ACR54964
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFIAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2882 - protein, 566 aa, Artificial Sequence; identical to SEQ ID NO: 2760
  hemagglutinin__InfluenzaA__ACR54974

SEQ ID NO: 2883 - protein, 566 aa, Artificial Sequence; identical to SEQ ID NO: 2669
  hemagglutinin__InfluenzaA__ACR54984

SEQ ID NO: 2884 - protein, 566 aa, Artificial Sequence; identical to SEQ ID NO: 2656
  hemagglutinin__InfluenzaA__ACR54994

SEQ ID NO: 2885 - protein, 566 aa, Artificial Sequence; identical to SEQ ID NO: 2656
  hemagglutinin__InfluenzaA__ACR55004

SEQ ID NO: 2886 - protein, 566 aa, Artificial Sequence; identical to SEQ ID NO: 2849
  hemagglutinin__InfluenzaA__ACR56380

SEQ ID NO: 2887 - protein, 566 aa, Artificial Sequence; identical to SEQ ID NO: 2722
  hemagglutinin__InfluenzaA__ACR56390

SEQ ID NO: 2888 - protein, 566 aa, Artificial Sequence; identical to SEQ ID NO: 2669
  hemagglutinin__InfluenzaA__ACR56400

SEQ ID NO: 2889 - protein, 566 aa, Artificial Sequence; identical to SEQ ID NO: 2669
  hemagglutinin__InfluenzaA__ACR56410

SEQ ID NO: 2890 - protein, 566 aa, Artificial Sequence; identical to SEQ ID NO: 2669
  hemagglutinin__InfluenzaA__ACR56420

SEQ ID NO: 2891 - protein, 566 aa, Artificial Sequence; identical to SEQ ID NO: 2669
  hemagglutinin__InfluenzaA__ACR56430

SEQ ID NO: 2892 - protein, 566 aa, Artificial Sequence; identical to SEQ ID NO: 2669
  hemagglutinin__InfluenzaA__ACR56440

SEQ ID NO: 2893 - protein, 565 aa, Artificial Sequence
  hemagglutinin__InfluenzaA__ACR58541
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTRKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIDKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 2894 - protein, 565 aa, Artificial Sequence; identical to SEQ ID NO: 1914
  hemagglutinin__InfluenzaA__ACR61655

SEQ ID NO: 2895 - protein, 565 aa, Artificial Sequence; identical to SEQ ID NO: 1930
  hemagglutinin__InfluenzaA__ACR61666

SEQ ID NO: 2896 - protein, 566 aa, Artificial Sequence; identical to SEQ ID NO: 2434
  hemagglutinin__InfluenzaA__ACR61677

SEQ ID NO: 2897 - protein, 566 aa, Artificial Sequence; identical to SEQ ID NO: 2434
  hemagglutinin__InfluenzaA__ACR61688

SEQ ID NO: 2898 - protein, 566 aa, Artificial Sequence; identical to SEQ ID NO: 2434
  hemagglutinin__InfluenzaA__ACR61699

SEQ ID NO: 2899 - protein, 566 aa, Artificial Sequence; identical to SEQ ID NO: 2656
  hemagglutinin__InfluenzaA__ACR67170

SEQ ID NO: 2900 - protein, 566 aa, Artificial Sequence; identical to SEQ ID NO: 2695
  hemagglutinin__InfluenzaA__ACR67171

SEQ ID NO: 2901 - protein, 566 aa, Artificial Sequence; identical to SEQ ID NO: 2656
  hemagglutinin__InfluenzaA__ACR67172

SEQ ID NO: 2902 - protein, 566 aa, Artificial Sequence; identical to SEQ ID NO: 2656
  hemagglutinin__InfluenzaA__ACR67177

SEQ ID NO: 2903 - protein, 566 aa, Artificial Sequence; identical to SEQ ID NO: 2656
  hemagglutinin__InfluenzaA__ACR67181

SEQ ID NO: 2904 - protein, 566 aa, Artificial Sequence
  hemagglutinin__InfluenzaA__ACR67183
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2905 - protein, 566 aa, Artificial Sequence; identical to SEQ ID NO: 2669
  hemagglutinin__InfluenzaA__ACR67184

SEQ ID NO: 2906 - protein, 566 aa, Artificial Sequence; identical to SEQ ID NO: 2656
  hemagglutinin__InfluenzaA__ACR67185

SEQ ID NO: 2907 - protein, 566 aa, Artificial Sequence; identical to SEQ ID NO: 2849
  hemagglutinin__InfluenzaA__ACR67186

SEQ ID NO: 2908 - protein, 566 aa, Artificial Sequence; identical to SEQ ID NO: 2656
  hemagglutinin__InfluenzaA__ACR67187

SEQ ID NO: 2909 - protein, 566 aa, Artificial Sequence; identical to SEQ ID NO: 2695
  hemagglutinin__InfluenzaA__ACR67188

SEQ ID NO: 2910 - protein, 566 aa, Artificial Sequence; identical to SEQ ID NO: 2695
  hemagglutinin__InfluenzaA__ACR67189

SEQ ID NO: 2911 - protein, 566 aa, Artificial Sequence
  hemagglutinin__InfluenzaA__ACR67190
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2912 - protein, 566 aa, Artificial Sequence; identical to SEQ ID NO: 2656
  hemagglutinin__InfluenzaA__ACR67192

SEQ ID NO: 2913 - protein, 566 aa, Artificial Sequence
  hemagglutinin__InfluenzaA__ACR67193
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHECNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2914 - protein, 566 aa, Artificial Sequence; identical to SEQ ID NO: 2656
  hemagglutinin__InfluenzaA__ACR67195

SEQ ID NO: 2915 - protein, 566 aa, Artificial Sequence; identical to SEQ ID NO: 2656
  hemagglutinin__InfluenzaA__ACR67197

SEQ ID NO: 2916 - protein, 566 aa, Artificial Sequence; identical to SEQ ID NO: 2913
  hemagglutinin__InfluenzaA__ACR67198

SEQ ID NO: 2917 - protein, 566 aa, Artificial Sequence; identical to SEQ ID NO: 2656
  hemagglutinin__InfluenzaA__ACR67199

SEQ ID NO: 2918 - protein, 566 aa, Artificial Sequence; identical to SEQ ID NO: 2669
  hemagglutinin__InfluenzaA__ACR67244

SEQ ID NO: 2919 - protein, 566 aa, Artificial Sequence
  hemagglutinin__InfluenzaA__ACR67254
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNVGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2920 - protein, 566 aa, Artificial Sequence; identical to SEQ ID NO: 2669
  hemagglutinin__InfluenzaA__ACR77438

SEQ ID NO: 2921 - protein, 566 aa, Artificial Sequence; identical to SEQ ID NO: 2669
  hemagglutinin__InfluenzaA__ACR77448

SEQ ID NO: 2922 - protein, 566 aa, Artificial Sequence
  hemagglutinin__InfluenzaA__ACR77458
MKAILVVLLYTFATANADTLCIGYHANNSTDTVDTVLEKNVTVTHSVNLLEDKHNGKLCKLRGVAPLHLDKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2923 - protein, 566 aa, Artificial Sequence; identical to SEQ ID NO: 2669
  hemagglutinin__InfluenzaA__ACR77468

SEQ ID NO: 2924 - protein, 566 aa, Artificial Sequence; identical to SEQ ID NO: 2669
  hemagglutinin__InfluenzaA__ACR77478

SEQ ID NO: 2925 - protein, 566 aa, Artificial Sequence; identical to SEQ ID NO: 2669
  hemagglutinin__InfluenzaA__ACR77488

SEQ ID NO: 2926 - protein, 566 aa, Artificial Sequence; identical to SEQ ID NO: 2669
  hemagglutinin__InfluenzaA__ACR77498

SEQ ID NO: 2927 - protein, 566 aa, Artificial Sequence; identical to SEQ ID NO: 2656
  hemagglutinin__InfluenzaA__ACR83525

SEQ ID NO: 2928 - protein, 566 aa, Artificial Sequence
  hemagglutinin__InfluenzaA__ACR83538
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSILSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2929 - protein, 566 aa, Artificial Sequence; identical to SEQ ID NO: 2669
  hemagglutinin__InfluenzaA__ACS14666

SEQ ID NO: 2930 - protein, 566 aa, Artificial Sequence; identical to SEQ ID NO: 2669
  hemagglutinin__InfluenzaA__ACS14676

SEQ ID NO: 2931 - protein, 566 aa, Artificial Sequence; identical to SEQ ID NO: 2669
  hemagglutinin__InfluenzaA__ACS14686

SEQ ID NO: 2932 - protein, 566 aa, Artificial Sequence; identical to SEQ ID NO: 2669
  hemagglutinin__InfluenzaA__ACS14696

SEQ ID NO: 2933 - protein, 566 aa, Artificial Sequence; identical to SEQ ID NO: 2669
  hemagglutinin__InfluenzaA__ACS14706

SEQ ID NO: 2934 - protein, 566 aa, Artificial Sequence; identical to SEQ ID NO: 2669
  hemagglutinin__InfluenzaA__ACS14716

SEQ ID NO: 2935 - protein, 566 aa, Artificial Sequence; identical to SEQ ID NO: 2669
  hemagglutinin__InfluenzaA__ACS14726

SEQ ID NO: 2936 - protein, 566 aa, Artificial Sequence; identical to SEQ ID NO: 2669
  hemagglutinin__InfluenzaA__ACS14736

SEQ ID NO: 2937 - protein, 566 aa, Artificial Sequence; identical to SEQ ID NO: 2849
  hemagglutinin__InfluenzaA__ACS27189

SEQ ID NO: 2938 - protein, 566 aa, Artificial Sequence; identical to SEQ ID NO: 2669
  hemagglutinin__InfluenzaA__ACS27199

SEQ ID NO: 2939 - protein, 566 aa, Artificial Sequence; identical to SEQ ID NO: 2669
  hemagglutinin__InfluenzaA__ACS27209

SEQ ID NO: 2940 - protein, 566 aa, Artificial Sequence; identical to SEQ ID NO: 2722
  hemagglutinin__InfluenzaA__ACS27219

SEQ ID NO: 2941 - protein, 566 aa, Artificial Sequence; identical to SEQ ID NO: 2669
  hemagglutinin__InfluenzaA__ACS27229

SEQ ID NO: 2942 - protein, 566 aa, Artificial Sequence
  hemagglutinin__InfluenzaA__ACS27239
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSMSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2943 - protein, 566 aa, Artificial Sequence; identical to SEQ ID NO: 2669
  hemagglutinin__InfluenzaA__ACS27249

SEQ ID NO: 2944 - protein, 566 aa, Artificial Sequence; identical to SEQ ID NO: 2669
  hemagglutinin__InfluenzaA__ACS27775

SEQ ID NO: 2945 - protein, 566 aa, Artificial Sequence; identical to SEQ ID NO: 2656
  hemagglutinin__InfluenzaA__ACS34705

SEQ ID NO: 2946 - protein, 566 aa, Artificial Sequence; identical to SEQ ID NO: 2656
  hemagglutinin__InfluenzaA__ACS34966

SEQ ID NO: 2947 - protein, 566 aa, Artificial Sequence
  hemagglutinin__InfluenzaA__ACS34967
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKSRLATGLRNVPSIQSRGLFGAIAGFIEGGWTGMVDGWYGYHHQNEQGSGYAADLKSTQKAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2948 - protein, 566 aa, Artificial Sequence
  hemagglutinin__InfluenzaA__ACS34968
MKAILVVLLYTFATANADTLCIGYHANNSTDTVDTVLEKNVTVTHSVNLLEDKHNGKLCKLRGVAPLHLGKCNIAGWILGNPECESLSTASSWSYIVESSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKIIFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2949 - protein, 566 aa, Artificial Sequence
  hemagglutinin__InfluenzaA__ACS36632
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQKAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2950 - protein, 566 aa, Artificial Sequence
  hemagglutinin__InfluenzaA__ACS36645
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGTKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKSNAKEIGNGCFEFYHKCDNTCMESVKNGTYDYPKYSEEAKLNREEIDGIKLESTRIYQILAIYSTVASSLVLVVSLGAISFWMCSNGSLQCRICI

SEQ ID NO: 2951 - protein, 566 aa, Artificial Sequence
  hemagglutinin__InfluenzaA__ACS45035
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSIYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2952 - protein, 566 aa, Artificial Sequence; identical to SEQ ID NO: 2669
  hemagglutinin__InfluenzaA__ACS50084

SEQ ID NO: 2953 - protein, 566 aa, Artificial Sequence; identical to SEQ ID NO: 2911
  hemagglutinin__InfluenzaA__ACS50095

SEQ ID NO: 2954 - protein, 566 aa, Artificial Sequence
  hemagglutinin__InfluenzaA__ACS54258
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYYYPKYSEEAKLNREEIDGVKLESTRIYQILAIYSTVASSLVLVVSLGAISFWMCSNGSLQCRICI

SEQ ID NO: 2955 - protein, 566 aa, Artificial Sequence; identical to SEQ ID NO: 2684
  hemagglutinin__InfluenzaA__ACS54259

SEQ ID NO: 2956 - protein, 566 aa, Artificial Sequence; identical to SEQ ID NO: 2656
  hemagglutinin__InfluenzaA__ACS54260

SEQ ID NO: 2957 - protein, 566 aa, Artificial Sequence; identical to SEQ ID NO: 2669
  hemagglutinin__InfluenzaA__ACS54261

SEQ ID NO: 2958 - protein, 566 aa, Artificial Sequence; identical to SEQ ID NO: 2669
  hemagglutinin__InfluenzaA__ACS54263

SEQ ID NO: 2959 - protein, 566 aa, Artificial Sequence; identical to SEQ ID NO: 2669
  hemagglutinin__InfluenzaA__ACS54301

SEQ ID NO: 2960 - protein, 566 aa, Artificial Sequence; identical to SEQ ID NO: 2656
  hemagglutinin__InfluenzaA__ACS66821

SEQ ID NO: 2961 - protein, 566 aa, Artificial Sequence
  hemagglutinin__InfluenzaA__ACS68822
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEGLREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2962 - protein, 566 aa, Artificial Sequence; identical to SEQ ID NO: 2669
  hemagglutinin__InfluenzaA__ACS75821

SEQ ID NO: 2963 - protein, 566 aa, Artificial Sequence; identical to SEQ ID NO: 2669
  hemagglutinin__InfluenzaA__ACS77926

SEQ ID NO: 2964 - protein, 566 aa, Artificial Sequence; identical to SEQ ID NO: 2669
  hemagglutinin__InfluenzaA__ACS77936

SEQ ID NO: 2965 - protein, 566 aa, Artificial Sequence; identical to SEQ ID NO: 2762
  hemagglutinin__InfluenzaA__ACS77946

SEQ ID NO: 2966 - protein, 566 aa, Artificial Sequence; identical to SEQ ID NO: 2669
  hemagglutinin__InfluenzaA__ACS77956

SEQ ID NO: 2967 - protein, 566 aa, Artificial Sequence; identical to SEQ ID NO: 2669
  hemagglutinin__InfluenzaA__ACS77966

SEQ ID NO: 2968 - protein, 566 aa, Artificial Sequence; identical to SEQ ID NO: 2669
  hemagglutinin__InfluenzaA__ACS77976

SEQ ID NO: 2969 - protein, 566 aa, Artificial Sequence; identical to SEQ ID NO: 2911
  hemagglutinin__InfluenzaA__ACS77986

SEQ ID NO: 2970 - protein, 566 aa, Artificial Sequence
  hemagglutinin__InfluenzaA__ACS77996
MKATLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2971 - protein, 566 aa, Artificial Sequence; identical to SEQ ID NO: 2669
  hemagglutinin__InfluenzaA__ACS78006

SEQ ID NO: 2972 - protein, 566 aa, Artificial Sequence; identical to SEQ ID NO: 2669
  hemagglutinin__InfluenzaA__ACS78016

SEQ ID NO: 2973 - protein, 566 aa, Artificial Sequence
  hemagglutinin__InfluenzaA__ACS78026
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKISSWPNHDSNRGVTAACPHAGAKSFYKNLIWLVKKGNSYPKLIKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2974 - protein, 566 aa, Artificial Sequence; identical to SEQ ID NO: 2911
  hemagglutinin__InfluenzaA__ACS78036

SEQ ID NO: 2975 - protein, 566 aa, Artificial Sequence; identical to SEQ ID NO: 2911
  hemagglutinin__InfluenzaA__ACS78046

SEQ ID NO: 2976 - protein, 566 aa, Artificial Sequence; identical to SEQ ID NO: 2684
  hemagglutinin__InfluenzaA__ACS92569

SEQ ID NO: 2977 - protein, 566 aa, Artificial Sequence; identical to SEQ ID NO: 2684
  hemagglutinin__InfluenzaA__ACS92579

SEQ ID NO: 2978 - protein, 566 aa, Artificial Sequence; identical to SEQ ID NO: 2669
  hemagglutinin__InfluenzaA__ACS92589

SEQ ID NO: 2979 - protein, 566 aa, Artificial Sequence
  hemagglutinin__InfluenzaA__ACS92612
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPIHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCDTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2980 - protein, 566 aa, Artificial Sequence; identical to SEQ ID NO: 2669
  hemagglutinin__InfluenzaA__ACT10307

SEQ ID NO: 2981 - protein, 566 aa, Artificial Sequence; identical to SEQ ID NO: 2669
  hemagglutinin__InfluenzaA__ACT10314

SEQ ID NO: 2982 - protein, 566 aa, Artificial Sequence
  hemagglutinin__InfluenzaA__ACT11057
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 2983 - protein, 567 aa, Artificial Sequence
  hemagglutinin__InfluenzaA__ACT15312
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2984 - protein, 567 aa, Artificial Sequence
  hemagglutinin__InfluenzaA__ACT15314
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAAEQTRLYQNPTTYISVGTSTLNQRLVPKITTRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2985 - protein, 567 aa, Artificial Sequence
  hemagglutinin__InfluenzaA__ACT15316
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2986 - protein, 567 aa, Artificial Sequence
  hemagglutinin__InfluenzaA__ACT15320
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGMSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2987 - protein, 567 aa, Artificial Sequence
  hemagglutinin__InfluenzaA__ACT15322
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLESRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2988 - protein, 567 aa, Artificial Sequence
  hemagglutinin__InfluenzaA__ACT15326
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLIPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2989 - protein, 567 aa, Artificial Sequence
  hemagglutinin__InfluenzaA__ACT15328
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQNGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPHYSEEARLKREEISGVKLESIGTYQILSIYSTVASSLALAIMVAGLFLWMCSNGSLQCRICI

SEQ ID NO: 2990 - protein, 567 aa, Artificial Sequence
  hemagglutinin__InfluenzaA__ACT15330
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPHYSEEARLKREEISGVKLESIGTYQILSIYSTVASSLALAIMVAGLFLWMCSNGSLQCRICI

SEQ ID NO: 2991 - protein, 568 aa, Artificial Sequence
  hemagglutinin__InfluenzaA__ACT15332
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGDFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYHNPTTYISVGTSTLNQRLVPKIATRSKINGQSGRMEFFWTILKPNDAINFESNGNFIAPENAYKIVKKGDSTIMKSELEYGNCNTKCQTPIGAINSSMPFHNIHPLTIGECPKYVKSSRLVLATGLRNSPQGKSRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGIYQILSIYSTVASSLALAIMVAGLFLWMCSNGSLQCRICI

SEQ ID NO: 2992 - protein, 567 aa, Artificial Sequence
  hemagglutinin__InfluenzaA__ACT15336
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2993 - protein, 567 aa, Artificial Sequence
  hemagglutinin__InfluenzaA__ACT15338
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDATEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQEGRRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2994 - protein, 567 aa, Artificial Sequence
  hemagglutinin__InfluenzaA__ACT15340
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAEEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNALERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2995 - protein, 567 aa, Artificial Sequence
  hemagglutinin__InfluenzaA__ACT15342
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGSFNDYEELKHLLSRINHFEKIQIIPKNSWSDHEASGVSSACPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLILATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2996 - protein, 567 aa, Artificial Sequence; identical to SEQ ID NO: 2992
  hemagglutinin__InfluenzaA__ACT15343

SEQ ID NO: 2997 - protein, 567 aa, Artificial Sequence
  hemagglutinin__InfluenzaA__ACT15345
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSSCPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFGSNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 2998 - protein, 568 aa, Artificial Sequence
  hemagglutinin__InfluenzaA__ACT15347
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGDFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYHNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSSRLVLATGLRNSPQGKNRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGIYQILSIYSTVASSLALAIMVAGLFLWMCSNGSLQCRICI

SEQ ID NO: 2999 - protein, 567 aa, Artificial Sequence
  hemagglutinin__InfluenzaA__ACT15349
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKDNAYPTIKRSYNNTNQEDLLVLWGIHHPNDATEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQEERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 3000 - protein, 568 aa, Artificial Sequence
  hemagglutinin__InfluenzaA__ACT15351
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGDFNDYEELKHLLSRINHFEKIQIIPKSSWSDHEASSGVSSACPYQGGSSFFRNVVWLIKKDNAYPTIKRSYNNTNQEDLLVLWGIHHPNDAAEQTRLYHNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSSRLVLATGLRNSPQGKSRRKKRGLFGAIAGFIEGGWQGMVDGWYGYHHSNEQGSGYAADKESTQRAIDGVTNKVNSIIDKMNTQFEAVGREFNKLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGIYQILSIYSTVASSLALAIMVAGLFLWMCSNGSLQCRICI

SEQ ID NO: 3001 - protein, 567 aa, Artificial Sequence
  hemagglutinin__InfluenzaA__ACT15353
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNSAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYSNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 3002 - protein, 568 aa, Artificial Sequence
  hemagglutinin__InfluenzaA__ACT15355
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGDFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYHNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSSRLVLATGLRNSPQGKSRRKKRGLFGAIAGFIEGGWQGMVDGWYGYHHSNEQGSGYAADKESTQRAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGIYQILSIYSTVASSLALAIMVAGLFLWMCSNGSLQCRICI

SEQ ID NO: 3003 - protein, 567 aa, Artificial Sequence
  hemagglutinin__InfluenzaA__ACT15357
MEKIVLLLAIVSLVKSDQICIGYHANNSTEQVDTIMERNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTQKDNAYPTIKRSYNNTNQEDLLVLWGIHHPNDAAEQTRLYQNPTTYISVGTSTLNQRLIPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 3004 - protein, 566 aa, Artificial Sequence
  hemagglutinin__InfluenzaA__ACT20200
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3005 - protein, 566 aa, Artificial Sequence
  hemagglutinin__InfluenzaA__ACT21466
MKTIIALSYILCLVFAQKLPGNDNSTATPCLGHHAVPNGTLVKTITNDQIEVTNATELVQSSSTGKICDSPHRILDGKNCTLIDALLGDPHCDGFKNKEWDLFVERSTAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3006 - protein, 566 aa, Artificial Sequence
  hemagglutinin__InfluenzaA__ACT21467
MKTIIALSYILCLVFAQKLPGSDNSTATLCLGHHAVPNGTLVKTITNDQIEVTNATELVQSSSTGKICDSPHRILDGKNCTLIDALLGDPHCDGFKNKEWDLFVERSTAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISVYWTIVKPRDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINRINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3007 - protein, 566 aa, Artificial Sequence
  hemagglutinin__InfluenzaA__ACT21468
MKTIIALSYILCLVFAQKLPGNDNSTATLCLGHHAVPNGTLVKTITNDQIEVTNATELVQSSSTGKICDSPHRILDGKNCTLIDALLGDPHCDGFKNKEWDLFVERSTAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFEKTRKQLRENVEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3008 - protein, 566 aa, Artificial Sequence
  hemagglutinin__InfluenzaA__ACT21469
MKTIIALSYISRLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQDGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3009 - protein, 566 aa, Artificial Sequence
  hemagglutinin__InfluenzaA__ACT21471
MKTIIALSYISCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQDGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3010 - protein, 566 aa, Artificial Sequence
  hemagglutinin__InfluenzaA__ACT21472
MKTIIALSYISCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQDGTSYACKRRSIKSFFSTLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3011 - protein, 566 aa, Artificial Sequence
  hemagglutinin__InfluenzaA__ACT21507
MKTIIALSYILCLVFAQKLPGNDNSTATLCLGHHAVPNGTIVKTITNDQIEVTNATELVQSSSTGGICDSPHQILDGENRTLIDALLGDPQCDGFQNKKWDLFVERSKAYSNCYPYDVPDYASLRSLVASSGTLEFNNESFNWTGVTQNGTSSACKGRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTRIDLWSYNAELLVALESQHTIDLTDSEMNKLFERTKKQLRENAEDMGNGCFKIYHKCDNACIGSIRNGTYDHDVYRDEALNKRFQIKGVELKSGYKDWILWISFAISCFLLCVALLGFIMWACQKGNIRCNICI

SEQ ID NO: 3012 - protein, 566 aa, Artificial Sequence
  hemagglutinin__InfluenzaA__ACT21508
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQDTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3013 - protein, 566 aa, Artificial Sequence
  hemagglutinin__InfluenzaA__ACT21509
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKPNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNETYDHDVYRDEALNNRFQIKGVELKSGYKDWILWISFAISCFLLCVALLGFIMWACQKGNIRCNICI

SEQ ID NO: 3014 - protein, 566 aa, Artificial Sequence
  hemagglutinin__InfluenzaA__ACT21510
MKTIIALSYILCPVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQDVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTEKQLRENAEDMGNGCFKIYHKCDNAGIGSIRNGTYDHDVYRDEALNNRFQIKGVELKSGYKDWILWISFAISCFLLCVALLGFIMWACQKGNIRCNICI

SEQ ID NO: 3015 - protein, 566 aa, Artificial Sequence; identical to SEQ ID NO: 2913
  hemagglutinin__InfluenzaA__ACT21572

SEQ ID NO: 3016 - protein, 566 aa, Artificial Sequence; identical to SEQ ID NO: 2669
  hemagglutinin__InfluenzaA__ACT22031

SEQ ID NO: 3017 - protein, 566 aa, Artificial Sequence; identical to SEQ ID NO: 2669
  hemagglutinin__InfluenzaA__ACT22032

SEQ ID NO: 3018 - protein, 566 aa, Artificial Sequence; identical to SEQ ID NO: 2669
  hemagglutinin__InfluenzaA__ACT22033

SEQ ID NO: 3019 - protein, 566 aa, Artificial Sequence; identical to SEQ ID NO: 2669
  hemagglutinin__InfluenzaA__ACT22034

SEQ ID NO: 3020 - protein, 566 aa, Artificial Sequence; identical to SEQ ID NO: 2684
  hemagglutinin__InfluenzaA__ACT22035

SEQ ID NO: 3021 - protein, 566 aa, Artificial Sequence
  hemagglutinin__InfluenzaA__ACT22036
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLIKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3022 - protein, 566 aa, Artificial Sequence
  hemagglutinin__InfluenzaA__ACT22037
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3023 - protein, 566 aa, Artificial Sequence
  hemagglutinin__InfluenzaA__ACT22038
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTNADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3024 - protein, 566 aa, Artificial Sequence
  hemagglutinin__InfluenzaA__ACT22055
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLRKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3025 - protein, 566 aa, Artificial Sequence; identical to SEQ ID NO: 2982
  hemagglutinin__InfluenzaA__ACT22504

SEQ ID NO: 3026 - protein, 566 aa, Artificial Sequence; identical to SEQ ID NO: 2911
  hemagglutinin__InfluenzaA__ACT33122

SEQ ID NO: 3027 - protein, 566 aa, Artificial Sequence
  hemagglutinin__InfluenzaA__ACT33123
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQFRICI

SEQ ID NO: 3028 - protein, 566 aa, Artificial Sequence; identical to SEQ ID NO: 2669
  hemagglutinin__InfluenzaA__ACT33125

SEQ ID NO: 3029 - protein, 566 aa, Artificial Sequence
  hemagglutinin__InfluenzaA__ACT36505
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3030 - protein, 566 aa, Artificial Sequence
  hemagglutinin__InfluenzaA__ACT36649
MKAILVVLLYTFATANADTLCIGYHANNSTDTVDTVLEKNVTVTHSVNLLEDKHNGKLCKLRGVAPLHLGKCNIAGWILGNPECESLSTARSWSYIVETSSSDNGTCYPGDFIDYEELREQLNSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKSLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3031 - protein, 566 aa, Artificial Sequence; identical to SEQ ID NO: 2669
  hemagglutinin__InfluenzaA__ACT36650

SEQ ID NO: 3032 - protein, 566 aa, Artificial Sequence; identical to SEQ ID NO: 2669
  hemagglutinin__InfluenzaA__ACT36652

SEQ ID NO: 3033 - protein, 566 aa, Artificial Sequence; identical to SEQ ID NO: 2667
  hemagglutinin__InfluenzaA__ACT36653

SEQ ID NO: 3034 - protein, 566 aa, Artificial Sequence
  hemagglutinin__InfluenzaA__ACT36655
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3035 - protein, 566 aa, Artificial Sequence; identical to SEQ ID NO: 2656
  hemagglutinin__InfluenzaA__ACT36658

SEQ ID NO: 3036 - protein, 566 aa, Artificial Sequence; identical to SEQ ID NO: 2695
  hemagglutinin__InfluenzaA__ACT36659

SEQ ID NO: 3037 - protein, 566 aa, Artificial Sequence; identical to SEQ ID NO: 2656
  hemagglutinin__InfluenzaA__ACT36661

SEQ ID NO: 3038 - protein, 566 aa, Artificial Sequence; identical to SEQ ID NO: 2669
  hemagglutinin__InfluenzaA__ACT36663

SEQ ID NO: 3039 - protein, 566 aa, Artificial Sequence; identical to SEQ ID NO: 2669
  hemagglutinin__InfluenzaA__ACT36666

SEQ ID NO: 3040 - protein, 566 aa, Artificial Sequence
  hemagglutinin__InfluenzaA__ACT52687
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRFYQILAIYSTVASSLVLVVSLGAISFWMCSNGSLQCRICI

SEQ ID NO: 3041 - protein, 566 aa, Artificial Sequence; identical to SEQ ID NO: 2656
  hemagglutinin__InfluenzaA__ACT54606

SEQ ID NO: 3042 - protein, 566 aa, Artificial Sequence; identical to SEQ ID NO: 2669
  hemagglutinin__InfluenzaA__ACT66146

SEQ ID NO: 3043 - protein, 566 aa, Artificial Sequence; identical to SEQ ID NO: 2911
  hemagglutinin__InfluenzaA__ACT66155

SEQ ID NO: 3044 - protein, 566 aa, Artificial Sequence
  hemagglutinin__InfluenzaA__ACT66162
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREHLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3045 - protein, 566 aa, Artificial Sequence; identical to SEQ ID NO: 2669
  hemagglutinin__InfluenzaA__ACT67239

SEQ ID NO: 3046 - protein, 566 aa, Artificial Sequence; identical to SEQ ID NO: 2669
  hemagglutinin__InfluenzaA__ACT67255

SEQ ID NO: 3047 - protein, 566 aa, Artificial Sequence; identical to SEQ ID NO: 2656
  hemagglutinin__InfluenzaA__ACT68102

SEQ ID NO: 3048 - protein, 566 aa, Artificial Sequence
  hemagglutinin__InfluenzaA__ACT68103
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTLKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3049 - protein, 566 aa, Artificial Sequence; identical to SEQ ID NO: 2656
  hemagglutinin__InfluenzaA__ACT68104

SEQ ID NO: 3050 - protein, 566 aa, Artificial Sequence
  hemagglutinin__InfluenzaA__ACT68105
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSGEAKLNREEIDGVKLESTRIYQILAIYSTVASSLVLVVSLGAISFWMCSNGSLQCRICI

SEQ ID NO: 3051 - protein, 566 aa, Artificial Sequence; identical to SEQ ID NO: 2656
  hemagglutinin__InfluenzaA__ACT68106

SEQ ID NO: 3052 - protein, 566 aa, Artificial Sequence; identical to SEQ ID NO: 2656
  hemagglutinin__InfluenzaA__ACT68107

SEQ ID NO: 3053 - protein, 566 aa, Artificial Sequence; identical to SEQ ID NO: 2849
  hemagglutinin__InfluenzaA__ACT68108

SEQ ID NO: 3054 - protein, 566 aa, Artificial Sequence
  hemagglutinin__InfluenzaA__ACT68109
MKAILVVLLYTFATANTDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3055 - protein, 566 aa, Artificial Sequence; identical to SEQ ID NO: 2656
  hemagglutinin__InfluenzaA__ACT68110

SEQ ID NO: 3056 - protein, 566 aa, Artificial Sequence; identical to SEQ ID NO: 2656
  hemagglutinin__InfluenzaA__ACT68112

SEQ ID NO: 3057 - protein, 566 aa, Artificial Sequence; identical to SEQ ID NO: 2656
  hemagglutinin__InfluenzaA__ACT68113

SEQ ID NO: 3058 - protein, 566 aa, Artificial Sequence; identical to SEQ ID NO: 2656
  hemagglutinin__InfluenzaA__ACT68115

SEQ ID NO: 3059 - protein, 566 aa, Artificial Sequence; identical to SEQ ID NO: 2656
  hemagglutinin__InfluenzaA__ACT68119

SEQ ID NO: 3060 - protein, 566 aa, Artificial Sequence
  hemagglutinin__InfluenzaA__ACT79133
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWKLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3061 - protein, 566 aa, Artificial Sequence; identical to SEQ ID NO: 2656
  hemagglutinin__InfluenzaA__ACT79143

SEQ ID NO: 3062 - protein, 566 aa, Artificial Sequence; identical to SEQ ID NO: 2695
  hemagglutinin__InfluenzaA__ACT79153

SEQ ID NO: 3063 - protein, 566 aa, Artificial Sequence; identical to SEQ ID NO: 2982
  hemagglutinin__InfluenzaA__ACT79163

SEQ ID NO: 3064 - protein, 566 aa, Artificial Sequence; identical to SEQ ID NO: 2982
  hemagglutinin__InfluenzaA__ACT79173

SEQ ID NO: 3065 - protein, 566 aa, Artificial Sequence
  hemagglutinin__InfluenzaA__ACT79625
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLKNERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3066 - protein, 566 aa, Artificial Sequence; identical to SEQ ID NO: 2656
  hemagglutinin__InfluenzaA__ACT79627

SEQ ID NO: 3067 - protein, 566 aa, Artificial Sequence
  hemagglutinin__InfluenzaA__ACT82512
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQFKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3068 - protein, 566 aa, Artificial Sequence; identical to SEQ ID NO: 2669
  hemagglutinin__InfluenzaA__ACT82513

SEQ ID NO: 3069 - protein, 566 aa, Artificial Sequence
  hemagglutinin__InfluenzaA__ACT82514
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISNTPVHDCNTTCQTPKGSINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3070 - protein, 566 aa, Artificial Sequence; identical to SEQ ID NO: 2669
  hemagglutinin__InfluenzaA__ACT82515

SEQ ID NO: 3071 - protein, 566 aa, Artificial Sequence
  hemagglutinin__InfluenzaA__ACT82516
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLMVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3072 - protein, 566 aa, Artificial Sequence; identical to SEQ ID NO: 2911
  hemagglutinin__InfluenzaA__ACT83795

SEQ ID NO: 3073 - protein, 566 aa, Artificial Sequence; identical to SEQ ID NO: 2911
  hemagglutinin__InfluenzaA__ACT83805

SEQ ID NO: 3074 - protein, 566 aa, Artificial Sequence; identical to SEQ ID NO: 2669
  hemagglutinin__InfluenzaA__ACT83815

SEQ ID NO: 3075 - protein, 566 aa, Artificial Sequence; identical to SEQ ID NO: 2669
  hemagglutinin__InfluenzaA__ACT83825

SEQ ID NO: 3076 - protein, 566 aa, Artificial Sequence; identical to SEQ ID NO: 2669
  hemagglutinin__InfluenzaA__ACT83835

SEQ ID NO: 3077 - protein, 566 aa, Artificial Sequence; identical to SEQ ID NO: 2762
  hemagglutinin__InfluenzaA__ACT83845

SEQ ID NO: 3078 - protein, 566 aa, Artificial Sequence; identical to SEQ ID NO: 2656
  hemagglutinin__InfluenzaA__ACT83855

SEQ ID NO: 3079 - protein, 566 aa, Artificial Sequence; identical to SEQ ID NO: 2669
  hemagglutinin__InfluenzaA__ACT83865

SEQ ID NO: 3080 - protein, 566 aa, Artificial Sequence; identical to SEQ ID NO: 2911
  hemagglutinin__InfluenzaA__ACT83875

SEQ ID NO: 3081 - protein, 566 aa, Artificial Sequence; identical to SEQ ID NO: 2911
  hemagglutinin__InfluenzaA__ACT85999

SEQ ID NO: 3082 - protein, 566 aa, Artificial Sequence; identical to SEQ ID NO: 2911
  hemagglutinin__InfluenzaA__ACT86009

SEQ ID NO: 3083 - protein, 566 aa, Artificial Sequence; identical to SEQ ID NO: 2669
  hemagglutinin__InfluenzaA__ACT86019

SEQ ID NO: 3084 - protein, 566 aa, Artificial Sequence; identical to SEQ ID NO: 2762
  hemagglutinin__InfluenzaA__ACT86029

SEQ ID NO: 3085 - protein, 566 aa, Artificial Sequence; identical to SEQ ID NO: 2669
  hemagglutinin__InfluenzaA__ACT86039

SEQ ID NO: 3086 - protein, 566 aa, Artificial Sequence; identical to SEQ ID NO: 2669
  hemagglutinin__InfluenzaA__ACT86059

SEQ ID NO: 3087 - protein, 566 aa, Artificial Sequence; identical to SEQ ID NO: 2669
  hemagglutinin__InfluenzaA__ACT86069

SEQ ID NO: 3088 - protein, 566 aa, Artificial Sequence; identical to SEQ ID NO: 2669
  hemagglutinin__InfluenzaA__ACT86079

SEQ ID NO: 3089 - protein, 566 aa, Artificial Sequence; identical to SEQ ID NO: 2669
  hemagglutinin__InfluenzaA__ACT86089

SEQ ID NO: 3090 - protein, 566 aa, Artificial Sequence; identical to SEQ ID NO: 2669
  hemagglutinin__InfluenzaA__ACT86099

SEQ ID NO: 3091 - protein, 566 aa, Artificial Sequence; identical to SEQ ID NO: 2911
  hemagglutinin__InfluenzaA__ACT86109

SEQ ID NO: 3092 - protein, 566 aa, Artificial Sequence; identical to SEQ ID NO: 2669
  hemagglutinin__InfluenzaA__ACT86119

SEQ ID NO: 3093 - protein, 566 aa, Artificial Sequence; identical to SEQ ID NO: 2911
  hemagglutinin__InfluenzaA__ACT86129

SEQ ID NO: 3094 - protein, 566 aa, Artificial Sequence; identical to SEQ ID NO: 2669
  hemagglutinin__InfluenzaA__ACT86139

SEQ ID NO: 3095 - protein, 566 aa, Artificial Sequence
  hemagglutinin__InfluenzaA__ACU00932
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKNFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3096 - protein, 566 aa, Artificial Sequence; identical to SEQ ID NO: 2669
  hemagglutinin__InfluenzaA__ACU00942

SEQ ID NO: 3097 - protein, 566 aa, Artificial Sequence; identical to SEQ ID NO: 2669
  hemagglutinin__InfluenzaA__ACU00952

SEQ ID NO: 3098 - protein, 566 aa, Artificial Sequence
  hemagglutinin__InfluenzaA__ACU12494
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGESYACKRGSVKSFFSRLNWLHESDYKYPALNVTMPNNGKFDKLYIWGVHHPITDREQTSLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3099 - protein, 565 aa, Artificial Sequence; identical to SEQ ID NO: 2781
  hemagglutinin__InfluenzaA__ACU12505

SEQ ID NO: 3100 - protein, 566 aa, Artificial Sequence
  hemagglutinin__InfluenzaA__ACU12516
MKTIIALSYILCLVFAQKLPGNDNSTATLCLGHHAVPNGTIVKTITNDQIEVTNATELVQSSSTGGICDSPHQILDGENCTLVDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPETQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3101 - protein, 566 aa, Artificial Sequence; identical to SEQ ID NO: 630
  hemagglutinin__InfluenzaA__ACU12527

SEQ ID NO: 3102 - protein, 566 aa, Artificial Sequence; identical to SEQ ID NO: 2372
  hemagglutinin__InfluenzaA__ACU12538

SEQ ID NO: 3103 - protein, 566 aa, Artificial Sequence; identical to SEQ ID NO: 1568
  hemagglutinin__InfluenzaA__ACU12549

SEQ ID NO: 3104 - protein, 565 aa, Artificial Sequence
  hemagglutinin__InfluenzaA__ACU12560
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKGKEVLVLWGVHHPPNIGDQNTLYHTENAYVSVVSSHYSRKFTPEIAKRPKVRDQEGRINYYWTLLEPGDTIIFEANGNLIAPRYAFALSRGFGSGIINSNVPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3105 - protein, 565 aa, Artificial Sequence; identical to SEQ ID NO: 2488
  hemagglutinin__InfluenzaA__ACU12571

SEQ ID NO: 3106 - protein, 565 aa, Artificial Sequence
  hemagglutinin__InfluenzaA__ACU12582
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGRFADYEELREQLSSVSSFERFEIFPKESSWPNHTVTGVSASCSHNGESSFYRNLLWLTGKNGLYPNLSKSYANNKGKEVLVLWGVHHPPNIGDQNTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3107 - protein, 565 aa, Artificial Sequence
  hemagglutinin__InfluenzaA__ACU12593
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAIDGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGIKLESMGVYQILAIYSTVASSLVLLVSLGAISFWMCSNGSLQCRICI

SEQ ID NO: 3108 - protein, 566 aa, Artificial Sequence; identical to SEQ ID NO: 2669
  hemagglutinin__InfluenzaA__ACU13090

SEQ ID NO: 3109 - protein, 566 aa, Artificial Sequence; identical to SEQ ID NO: 2669
  hemagglutinin__InfluenzaA__ACU13091

SEQ ID NO: 3110 - protein, 566 aa, Artificial Sequence; identical to SEQ ID NO: 2669
  hemagglutinin__InfluenzaA__ACU13092

SEQ ID NO: 3111 - protein, 566 aa, Artificial Sequence; identical to SEQ ID NO: 2669
  hemagglutinin__InfluenzaA__ACU13093

SEQ ID NO: 3112 - protein, 566 aa, Artificial Sequence
  hemagglutinin__InfluenzaA__ACU13094
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3113 - protein, 566 aa, Artificial Sequence; identical to SEQ ID NO: 2669
  hemagglutinin__InfluenzaA__ACU13095

SEQ ID NO: 3114 - protein, 566 aa, Artificial Sequence
  hemagglutinin__InfluenzaA__ACU13096
MKAILVVLLHTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVTLESTRIYQILAIYSTVASSLVLVVSLGAISFWMCSNGSLQCRICI

SEQ ID NO: 3115 - protein, 566 aa, Artificial Sequence; identical to SEQ ID NO: 2669
  hemagglutinin__InfluenzaA__ACU13098

SEQ ID NO: 3116 - protein, 566 aa, Artificial Sequence
  hemagglutinin__InfluenzaA__ACU13099
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3117 - protein, 566 aa, Artificial Sequence
  hemagglutinin__InfluenzaA__ACU13129
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGEEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3118 - protein, 566 aa, Artificial Sequence; identical to SEQ ID NO: 2669
  hemagglutinin__InfluenzaA__ACU16795

SEQ ID NO: 3119 - protein, 566 aa, Artificial Sequence; identical to SEQ ID NO: 2669
  hemagglutinin__InfluenzaA__ACU16858

SEQ ID NO: 3120 - protein, 566 aa, Artificial Sequence; identical to SEQ ID NO: 2669
  hemagglutinin__InfluenzaA__ACU16930

SEQ ID NO: 3121 - protein, 566 aa, Artificial Sequence; identical to SEQ ID NO: 2669
  hemagglutinin__InfluenzaA__ACU16993

SEQ ID NO: 3122 - protein, 566 aa, Artificial Sequence; identical to SEQ ID NO: 2669
  hemagglutinin__InfluenzaA__ACU17059

SEQ ID NO: 3123 - protein, 566 aa, Artificial Sequence; identical to SEQ ID NO: 2669
  hemagglutinin__InfluenzaA__ACU17126

SEQ ID NO: 3124 - protein, 566 aa, Artificial Sequence; identical to SEQ ID NO: 2760
  hemagglutinin__InfluenzaA__ACU17187

SEQ ID NO: 3125 - protein, 566 aa, Artificial Sequence; identical to SEQ ID NO: 2669
  hemagglutinin__InfluenzaA__ACU17258

SEQ ID NO: 3126 - protein, 566 aa, Artificial Sequence
  hemagglutinin__InfluenzaA__ACU17389
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTACQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3127 - protein, 566 aa, Artificial Sequence; identical to SEQ ID NO: 2669
  hemagglutinin__InfluenzaA__ACU17450

SEQ ID NO: 3128 - protein, 566 aa, Artificial Sequence; identical to SEQ ID NO: 2669
  hemagglutinin__InfluenzaA__ACU17521

SEQ ID NO: 3129 - protein, 566 aa, Artificial Sequence; identical to SEQ ID NO: 2656
  hemagglutinin__InfluenzaA__ACU27041

SEQ ID NO: 3130 - protein, 565 aa, Artificial Sequence
  hemagglutinin__InfluenzaA__ACU27406
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKIRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIERMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3131 - protein, 565 aa, Artificial Sequence
  hemagglutinin__InfluenzaA__ACU27407
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3132 - protein, 566 aa, Artificial Sequence; identical to SEQ ID NO: 2656
  hemagglutinin__InfluenzaA__ACU29949

SEQ ID NO: 3133 - protein, 566 aa, Artificial Sequence
  hemagglutinin__InfluenzaA__ACU29979
MKAILVVLLYTFAAANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3134 - protein, 566 aa, Artificial Sequence; identical to SEQ ID NO: 2669
  hemagglutinin__InfluenzaA__ACU29989

SEQ ID NO: 3135 - protein, 567 aa, Artificial Sequence
  hemagglutinin__InfluenzaA__ACU29999
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLLQCRICI

SEQ ID NO: 3136 - protein, 567 aa, Artificial Sequence
  hemagglutinin__InfluenzaA__ACU30009
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGYGSLQCRICI

SEQ ID NO: 3137 - protein, 566 aa, Artificial Sequence; identical to SEQ ID NO: 3029
  hemagglutinin__InfluenzaA__ACU30019

SEQ ID NO: 3138 - protein, 566 aa, Artificial Sequence; identical to SEQ ID NO: 2849
  hemagglutinin__InfluenzaA__ACU30093

SEQ ID NO: 3139 - protein, 566 aa, Artificial Sequence
  hemagglutinin__InfluenzaA__ACU30103
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3140 - protein, 567 aa, Artificial Sequence
  hemagglutinin__InfluenzaA__ACU30112
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSHMVLLQCRICI

SEQ ID NO: 3141 - protein, 566 aa, Artificial Sequence
  hemagglutinin__InfluenzaA__ACU30121
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3142 - protein, 566 aa, Artificial Sequence; identical to SEQ ID NO: 2762
  hemagglutinin__InfluenzaA__ACU31124

SEQ ID NO: 3143 - protein, 566 aa, Artificial Sequence; identical to SEQ ID NO: 2701
  hemagglutinin__InfluenzaA__ACU31143

SEQ ID NO: 3144 - protein, 566 aa, Artificial Sequence; identical to SEQ ID NO: 2701
  hemagglutinin__InfluenzaA__ACU31144

SEQ ID NO: 3145 - protein, 566 aa, Artificial Sequence; identical to SEQ ID NO: 2701
  hemagglutinin__InfluenzaA__ACU31145

SEQ ID NO: 3146 - protein, 566 aa, Artificial Sequence; identical to SEQ ID NO: 2849
  hemagglutinin__InfluenzaA__ACU31146

SEQ ID NO: 3147 - protein, 566 aa, Artificial Sequence; identical to SEQ ID NO: 2669
  hemagglutinin__InfluenzaA__ACU31147

SEQ ID NO: 3148 - protein, 566 aa, Artificial Sequence
  hemagglutinin__InfluenzaA__ACU31148
MKAILVIMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3149 - protein, 566 aa, Artificial Sequence; identical to SEQ ID NO: 2656
  hemagglutinin__InfluenzaA__ACU31149

SEQ ID NO: 3150 - protein, 566 aa, Artificial Sequence; identical to SEQ ID NO: 2656
  hemagglutinin__InfluenzaA__ACU31150

SEQ ID NO: 3151 - protein, 566 aa, Artificial Sequence; identical to SEQ ID NO: 2656
  hemagglutinin__InfluenzaA__ACU31151

SEQ ID NO: 3152 - protein, 566 aa, Artificial Sequence; identical to SEQ ID NO: 2656
  hemagglutinin__InfluenzaA__ACU31152

SEQ ID NO: 3153 - protein, 568 aa, Artificial Sequence
  hemagglutinin__InfluenzaA__ACU46644
MEKIVLLFAIVSLVKSDQICIGYHANNSTEQVDTIMEKNVTVTHAQDILEKTHNGKLCDLDGGKPLILRDCRVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWWIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHHIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNHLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGIYQILSIYSTVASSLALAIMVAGLSLWMCSNGSLQCRICI

SEQ ID NO: 3154 - protein, 566 aa, Artificial Sequence
  hemagglutinin__InfluenzaA__ACU56924
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3155 - protein, 566 aa, Artificial Sequence; identical to SEQ ID NO: 3022
  hemagglutinin__InfluenzaA__ACU56931

SEQ ID NO: 3156 - protein, 566 aa, Artificial Sequence; identical to SEQ ID NO: 2669
  hemagglutinin__InfluenzaA__ACU64792

SEQ ID NO: 3157 - protein, 566 aa, Artificial Sequence; identical to SEQ ID NO: 2849
  hemagglutinin__InfluenzaA__ACU64801

SEQ ID NO: 3158 - protein, 566 aa, Artificial Sequence; identical to SEQ ID NO: 2849
  hemagglutinin__InfluenzaA__ACU64812

SEQ ID NO: 3159 - protein, 566 aa, Artificial Sequence; identical to SEQ ID NO: 2318
  hemagglutinin__InfluenzaA__ACU79871

SEQ ID NO: 3160 - protein, 566 aa, Artificial Sequence; identical to SEQ ID NO: 2316
  hemagglutinin__InfluenzaA__ACU79882

SEQ ID NO: 3161 - protein, 566 aa, Artificial Sequence; identical to SEQ ID NO: 2329
  hemagglutinin__InfluenzaA__ACU79893

SEQ ID NO: 3162 - protein, 566 aa, Artificial Sequence; identical to SEQ ID NO: 2329
  hemagglutinin__InfluenzaA__ACU79904

SEQ ID NO: 3163 - protein, 565 aa, Artificial Sequence
  hemagglutinin__InfluenzaA__ACU79937
MKAKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVTASCSHNGKSSFYRNLLWLTEKNGLYPNLSNSYVNNKEKEVLVLWGVHHPSNIGVQRAIYHTENAYVSVVSSHYSRRFTPEIAKRPKVRGQEGRINYYWTLLEPGDTIIFEANGNLIAPWYAFALSRGFGSGIITSNAPMNECDAKCQTPQGAINSSLPFQNVHPVTIGECPKYVRSTKLRMVTGLRNIPSIQSRGLFGAIAGFIEGGWTGMMDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 3164 - protein, 562 aa, Artificial Sequence
  hemagglutinin__InfluenzaA__ACU79948
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSDYPVAKGSYNNTSGEQMLIIWGVHHPNDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNNVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 3165 - protein, 562 aa, Artificial Sequence
  hemagglutinin__InfluenzaA__ACU79959
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSDYPVAKGSYNNTSGEQMLIIWGVHHPNDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 3166 - protein, 566 aa, Artificial Sequence
  hemagglutinin__InfluenzaA__ACU79970
MKTIIALSYIQCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSKLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 3167 - protein, 565 aa, Artificial Sequence
  hemagglutinin__InfluenzaA__ACU79981
MKVKLLVLLCTFTATYADTICIGYHANNSTDTVDTVLERNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLKPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3168 - protein, 565 aa, Artificial Sequence
  hemagglutinin__InfluenzaA__ACU79992
MKVKLLVLLCTFTATYADTICIGYHANNSTDTVDTVLEKNVTVTHSVNLLEDNHNGKLCLLKGKAPLQLGNCSVAGWILGNPECGLLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 3169 - protein, 566 aa, Artificial Sequence; identical to SEQ ID NO: 2434
  hemagglutinin__InfluenzaA__ACU80003

SEQ ID NO: 3170 - protein, 565 aa, Artificial Sequence
  hemagglutinin__InfluenzaA__ACU80025
MKVKLLVLLCTFAATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3171 - protein, 566 aa, Artificial Sequence
  hemagglutinin__InfluenzaA__ACU80036
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCSSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDIGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3172 - protein, 565 aa, Artificial Sequence; identical to SEQ ID NO: 2643
  hemagglutinin__InfluenzaA__ACU80047

SEQ ID NO: 3173 - protein, 566 aa, Artificial Sequence
  hemagglutinin__InfluenzaA__ACU80058
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKACSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3174 - protein, 565 aa, Artificial Sequence; identical to SEQ ID NO: 2488
  hemagglutinin__InfluenzaA__ACU80069

SEQ ID NO: 3175 - protein, 565 aa, Artificial Sequence
  hemagglutinin__InfluenzaA__ACU80080
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGIKLESMGVYQILAIYSTVASSLVLLVSLGAISFWMCSNGSLQCRICI

SEQ ID NO: 3176 - protein, 565 aa, Artificial Sequence; identical to SEQ ID NO: 2774
  hemagglutinin__InfluenzaA__ACU80091

SEQ ID NO: 3177 - protein, 566 aa, Artificial Sequence; identical to SEQ ID NO: 2537
  hemagglutinin__InfluenzaA__ACU80102

SEQ ID NO: 3178 - protein, 566 aa, Artificial Sequence
  hemagglutinin__InfluenzaA__ACU80113
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEIEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKNWILWISFAISCFLLCIALLGFIMWACQKGNIRCNICI

SEQ ID NO: 3179 - protein, 566 aa, Artificial Sequence
  hemagglutinin__InfluenzaA__ACU80135
MKTIIALSYILCLVFAQKFPGNDNSTATLCLGHHAVPNGTMVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 3180 - protein, 566 aa, Artificial Sequence
  hemagglutinin__InfluenzaA__ACU80146
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGLIMWACQKGNIRCNICI

SEQ ID NO: 3181 - protein, 566 aa, Artificial Sequence; identical to SEQ ID NO: 2434
  hemagglutinin__InfluenzaA__ACU80157

SEQ ID NO: 3182 - protein, 565 aa, Artificial Sequence; identical to SEQ ID NO: 3170
  hemagglutinin__InfluenzaA__ACU80168

SEQ ID NO: 3183 - protein, 566 aa, Artificial Sequence; identical to SEQ ID NO: 2434
  hemagglutinin__InfluenzaA__ACU80179

SEQ ID NO: 3184 - protein, 566 aa, Artificial Sequence
  hemagglutinin__InfluenzaA__ACU80190
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGIELKSGYKDWILWISFAISCFLLCVALLGFIMWACQKGNIRCNICI

SEQ ID NO: 3185 - protein, 566 aa, Artificial Sequence
  hemagglutinin__InfluenzaA__ACU80201
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIKCNICI

SEQ ID NO: 3186 - protein, 566 aa, Artificial Sequence; identical to SEQ ID NO: 2434
  hemagglutinin__InfluenzaA__ACU80212

SEQ ID NO: 3187 - protein, 565 aa, Artificial Sequence
  hemagglutinin__InfluenzaA__ACU80234
MKVKLLVLLCTFAATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3188 - protein, 566 aa, Artificial Sequence
  hemagglutinin__InfluenzaA__ACU80245
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGRCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 3189 - protein, 566 aa, Artificial Sequence; identical to SEQ ID NO: 2537
  hemagglutinin__InfluenzaA__ACU80256

SEQ ID NO: 3190 - protein, 565 aa, Artificial Sequence; identical to SEQ ID NO: 2488
  hemagglutinin__InfluenzaA__ACU80267

SEQ ID NO: 3191 - protein, 565 aa, Artificial Sequence; identical to SEQ ID NO: 3170
  hemagglutinin__InfluenzaA__ACU80278

SEQ ID NO: 3192 - protein, 566 aa, Artificial Sequence; identical to SEQ ID NO: 2434
  hemagglutinin__InfluenzaA__ACU80289

SEQ ID NO: 3193 - protein, 566 aa, Artificial Sequence; identical to SEQ ID NO: 2537
  hemagglutinin__InfluenzaA__ACU80300

SEQ ID NO: 3194 - protein, 566 aa, Artificial Sequence
  hemagglutinin__InfluenzaA__ACU80311
MRTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 3195 - protein, 566 aa, Artificial Sequence; identical to SEQ ID NO: 2537
  hemagglutinin__InfluenzaA__ACU80322

SEQ ID NO: 3196 - protein, 566 aa, Artificial Sequence; identical to SEQ ID NO: 2434
  hemagglutinin__InfluenzaA__ACU80333

SEQ ID NO: 3197 - protein, 566 aa, Artificial Sequence; identical to SEQ ID NO: 2537
  hemagglutinin__InfluenzaA__ACU80344

SEQ ID NO: 3198 - protein, 566 aa, Artificial Sequence; identical to SEQ ID NO: 2537
  hemagglutinin__InfluenzaA__ACU80355

SEQ ID NO: 3199 - protein, 566 aa, Artificial Sequence; identical to SEQ ID NO: 2537
  hemagglutinin__InfluenzaA__ACU80366

SEQ ID NO: 3200 - protein, 566 aa, Artificial Sequence
  hemagglutinin__InfluenzaA__ACU80377
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNFECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAMSCFLLCIALLGFIMWACQKGNIRCNICI

SEQ ID NO: 3201 - protein, 566 aa, Artificial Sequence; identical to SEQ ID NO: 2537
  hemagglutinin__InfluenzaA__ACU80388

SEQ ID NO: 3202 - protein, 566 aa, Artificial Sequence; identical to SEQ ID NO: 2434
  hemagglutinin__InfluenzaA__ACU80399

SEQ ID NO: 3203 - protein, 565 aa, Artificial Sequence
  hemagglutinin__InfluenzaA__ACU80410
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3204 - protein, 566 aa, Artificial Sequence
  hemagglutinin__InfluenzaA__ACU80424
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLVASSGTLEFNNESFNWTGVTQNGTSSACIRRSNNSFFSRLNWLTHSKFKYPALNVTMPNNENFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNFECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 3205 - protein, 566 aa, Artificial Sequence; identical to SEQ ID NO: 3204
  hemagglutinin__InfluenzaA__ACU80435

SEQ ID NO: 3206 - protein, 565 aa, Artificial Sequence
  hemagglutinin__InfluenzaA__ACU80446
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMEVYQILAIYSTVASSLVLLVSLGAISFWMCSNGSLQCRICI

SEQ ID NO: 3207 - protein, 566 aa, Artificial Sequence; identical to SEQ ID NO: 2434
  hemagglutinin__InfluenzaA__ACU80458

SEQ ID NO: 3208 - protein, 566 aa, Artificial Sequence; identical to SEQ ID NO: 2434
  hemagglutinin__InfluenzaA__ACU80470

SEQ ID NO: 3209 - protein, 566 aa, Artificial Sequence; identical to SEQ ID NO: 2537
  hemagglutinin__InfluenzaA__ACU80600

SEQ ID NO: 3210 - protein, 566 aa, Artificial Sequence; identical to SEQ ID NO: 3204
  hemagglutinin__InfluenzaA__ACU80611

SEQ ID NO: 3211 - protein, 566 aa, Artificial Sequence; identical to SEQ ID NO: 2537
  hemagglutinin__InfluenzaA__ACU80622

SEQ ID NO: 3212 - protein, 566 aa, Artificial Sequence; identical to SEQ ID NO: 2434
  hemagglutinin__InfluenzaA__ACU80633

SEQ ID NO: 3213 - protein, 566 aa, Artificial Sequence
  hemagglutinin__InfluenzaA__ACU80644
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3214 - protein, 566 aa, Artificial Sequence; identical to SEQ ID NO: 2434
  hemagglutinin__InfluenzaA__ACU80655

SEQ ID NO: 3215 - protein, 566 aa, Artificial Sequence; identical to SEQ ID NO: 2434
  hemagglutinin__InfluenzaA__ACU80666

SEQ ID NO: 3216 - protein, 566 aa, Artificial Sequence; identical to SEQ ID NO: 1928
  hemagglutinin__InfluenzaA__ACU80677

SEQ ID NO: 3217 - protein, 566 aa, Artificial Sequence; identical to SEQ ID NO: 2434
  hemagglutinin__InfluenzaA__ACU80688

SEQ ID NO: 3218 - protein, 566 aa, Artificial Sequence; identical to SEQ ID NO: 2537
  hemagglutinin__InfluenzaA__ACU80699

SEQ ID NO: 3219 - protein, 566 aa, Artificial Sequence; identical to SEQ ID NO: 2537
  hemagglutinin__InfluenzaA__ACU80710

SEQ ID NO: 3220 - protein, 566 aa, Artificial Sequence
  hemagglutinin__InfluenzaA__ACU80721
MKTIIALSYILCLVFAQKLPGNDNSTATLCLGHHAVPNGTIVKTITNDQTEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3221 - protein, 566 aa, Artificial Sequence; identical to SEQ ID NO: 2434
  hemagglutinin__InfluenzaA__ACU80732

SEQ ID NO: 3222 - protein, 566 aa, Artificial Sequence; identical to SEQ ID NO: 2434
  hemagglutinin__InfluenzaA__ACU80743

SEQ ID NO: 3223 - protein, 566 aa, Artificial Sequence
  hemagglutinin__InfluenzaA__ACU80754
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3224 - protein, 566 aa, Artificial Sequence
  hemagglutinin__InfluenzaA__ACU80765
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 3225 - protein, 566 aa, Artificial Sequence
  hemagglutinin__InfluenzaA__ACU80787
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3226 - protein, 566 aa, Artificial Sequence; identical to SEQ ID NO: 2434
  hemagglutinin__InfluenzaA__ACU80798

SEQ ID NO: 3227 - protein, 566 aa, Artificial Sequence; identical to SEQ ID NO: 2434
  hemagglutinin__InfluenzaA__ACU81103

SEQ ID NO: 3228 - protein, 566 aa, Artificial Sequence
  hemagglutinin__InfluenzaA__ACU87270
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLIEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3229 - protein, 566 aa, Artificial Sequence; identical to SEQ ID NO: 2669
  hemagglutinin__InfluenzaA__ACV04228

SEQ ID NO: 3230 - protein, 566 aa, Artificial Sequence; identical to SEQ ID NO: 2669
  hemagglutinin__InfluenzaA__ACV04238

SEQ ID NO: 3231 - protein, 566 aa, Artificial Sequence
  hemagglutinin__InfluenzaA__ACV04248
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3232 - protein, 566 aa, Artificial Sequence; identical to SEQ ID NO: 2669
  hemagglutinin__InfluenzaA__ACV04258

SEQ ID NO: 3233 - protein, 566 aa, Artificial Sequence; identical to SEQ ID NO: 2669
  hemagglutinin__InfluenzaA__ACV04268

SEQ ID NO: 3234 - protein, 566 aa, Artificial Sequence; identical to SEQ ID NO: 2669
  hemagglutinin__InfluenzaA__ACV04278

SEQ ID NO: 3235 - protein, 566 aa, Artificial Sequence; identical to SEQ ID NO: 2669
  hemagglutinin__InfluenzaA__ACV04288

SEQ ID NO: 3236 - protein, 566 aa, Artificial Sequence
  hemagglutinin__InfluenzaA__ACV04298
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPVTIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3237 - protein, 566 aa, Artificial Sequence; identical to SEQ ID NO: 2669
  hemagglutinin__InfluenzaA__ACV04308

SEQ ID NO: 3238 - protein, 566 aa, Artificial Sequence
  hemagglutinin__InfluenzaA__ACV04318
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3239 - protein, 566 aa, Artificial Sequence; identical to SEQ ID NO: 2669
  hemagglutinin__InfluenzaA__ACV04328

SEQ ID NO: 3240 - protein, 566 aa, Artificial Sequence; identical to SEQ ID NO: 2669
  hemagglutinin__InfluenzaA__ACV04338

SEQ ID NO: 3241 - protein, 566 aa, Artificial Sequence; identical to SEQ ID NO: 2911
  hemagglutinin__InfluenzaA__ACV04358

SEQ ID NO: 3242 - protein, 566 aa, Artificial Sequence
  hemagglutinin__InfluenzaA__ACV04368
MKAILVVLLYTFATANADTLCIGYHANNSTDTVDTVLEKNVTVTHSVNLLEDKHNGKLCQLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3243 - protein, 566 aa, Artificial Sequence
  hemagglutinin__InfluenzaA__ACV04378
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 3244 - protein, 566 aa, Artificial Sequence; identical to SEQ ID NO: 2911
  hemagglutinin__InfluenzaA__ACV04388

SEQ ID NO: 3245 - protein, 566 aa, Artificial Sequence; identical to SEQ ID NO: 2669
  hemagglutinin__InfluenzaA__ACV04398

SEQ ID NO: 3246 - protein, 566 aa, Artificial Sequence; identical to SEQ ID NO: 2913
  hemagglutinin__InfluenzaA__ACV04408

SEQ ID NO: 3247 - protein, 566 aa, Artificial Sequence; identical to SEQ ID NO: 2669
  hemagglutinin__InfluenzaA__ACV04489

SEQ ID NO: 3248 - protein, 566 aa, Artificial Sequence; identical to SEQ ID NO: 2669
  hemagglutinin__InfluenzaA__ACV04499

SEQ ID NO: 3249 - protein, 566 aa, Artificial Sequence; identical to SEQ ID NO: 2849
  hemagglutinin__InfluenzaA__ACV04509

SEQ ID NO: 3250 - protein, 566 aa, Artificial Sequence; identical to SEQ ID NO: 2669
  hemagglutinin__InfluenzaA__ACV04519

SEQ ID NO: 3251 - protein, 566 aa, Artificial Sequence; identical to SEQ ID NO: 2669
  hemagglutinin__InfluenzaA__ACV04529

SEQ ID NO: 3252 - protein, 566 aa, Artificial Sequence; identical to SEQ ID NO: 2669
  hemagglutinin__InfluenzaA__ACV04549

SEQ ID NO: 3253 - protein, 566 aa, Artificial Sequence; identical to SEQ ID NO: 2669
  hemagglutinin__InfluenzaA__ACV04559

SEQ ID NO: 3254 - protein, 566 aa, Artificial Sequence; identical to SEQ ID NO: 2669
  hemagglutinin__InfluenzaA__ACV04579

SEQ ID NO: 3255 - protein, 566 aa, Artificial Sequence
  hemagglutinin__InfluenzaA__ACV04751
MEAILVVMLYTFATANADTLCIGYHANNSTDTVDTVLEKNVTVTHSVNLLEDKHNGKLCKLRGVAPLRLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNTKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3256 - protein, 566 aa, Artificial Sequence
  hemagglutinin__InfluenzaA__ACV04752
MEAILVVLLYTFATANADTLCIGYHANNSTDTVDTVLEKNVTVTHSVNILEDKHNGKLCKLRGVAPLHLGKCNIAGWILENPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3257 - protein, 566 aa, Artificial Sequence
  hemagglutinin__InfluenzaA__ACV04753
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3258 - protein, 566 aa, Artificial Sequence
  hemagglutinin__InfluenzaA__ACV04754
MEAILVVLLYTFATANADTLCIGYHANNSTDTVDTVLEKNVPVTHSVNLLKDKHNGKLCKLRGVAPLHLGKCNIAGWILGNPECESLSTASSWSYIVETSSSDNGTCYPGDFIDYEELREQLSSVSSFERFEIFPKTSSWPNHESNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGVFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3259 - protein, 566 aa, Artificial Sequence; identical to SEQ ID NO: 3154
  hemagglutinin__InfluenzaA__ACV04755

SEQ ID NO: 3260 - protein, 566 aa, Artificial Sequence; identical to SEQ ID NO: 2849
  hemagglutinin__InfluenzaA__ACV33084

SEQ ID NO: 3261 - protein, 566 aa, Artificial Sequence; identical to SEQ ID NO: 2669
  hemagglutinin__InfluenzaA__ACV33094

SEQ ID NO: 3262 - protein, 566 aa, Artificial Sequence; identical to SEQ ID NO: 2669
  hemagglutinin__InfluenzaA__ACV33104

SEQ ID NO: 3263 - protein, 566 aa, Artificial Sequence; identical to SEQ ID NO: 2669
  hemagglutinin__InfluenzaA__ACV33114

SEQ ID NO: 3264 - protein, 566 aa, Artificial Sequence; identical to SEQ ID NO: 2669
  hemagglutinin__InfluenzaA__ACV33124

SEQ ID NO: 3265 - protein, 566 aa, Artificial Sequence; identical to SEQ ID NO: 2669
  hemagglutinin__InfluenzaA__ACV33134

SEQ ID NO: 3266 - protein, 566 aa, Artificial Sequence; identical to SEQ ID NO: 3231
  hemagglutinin__InfluenzaA__ACV33144

SEQ ID NO: 3267 - protein, 566 aa, Artificial Sequence; identical to SEQ ID NO: 2669
  hemagglutinin__InfluenzaA__ACV33154

SEQ ID NO: 3268 - protein, 566 aa, Artificial Sequence; identical to SEQ ID NO: 2669
  hemagglutinin__InfluenzaA__ACV33164

SEQ ID NO: 3269 - protein, 566 aa, Artificial Sequence; identical to SEQ ID NO: 2669
  hemagglutinin__InfluenzaA__ACV33174

SEQ ID NO: 3270 - protein, 566 aa, Artificial Sequence; identical to SEQ ID NO: 2656
  hemagglutinin__InfluenzaA__ACV41981

SEQ ID NO: 3271 - protein, 566 aa, Artificial Sequence; identical to SEQ ID NO: 2695
  hemagglutinin__InfluenzaA__ACV41991

SEQ ID NO: 3272 - protein, 566 aa, Artificial Sequence; identical to SEQ ID NO: 2695
  hemagglutinin__InfluenzaA__ACV42001

SEQ ID NO: 3273 - protein, 566 aa, Artificial Sequence; identical to SEQ ID NO: 2669
  hemagglutinin__InfluenzaA__ACV42008

SEQ ID NO: 3274 - protein, 566 aa, Artificial Sequence; identical to SEQ ID NO: 2669
  hemagglutinin__InfluenzaA__ACV42018

SEQ ID NO: 3275 - protein, 566 aa, Artificial Sequence; identical to SEQ ID NO: 2316
  hemagglutinin__InfluenzaA__ACV49501

SEQ ID NO: 3276 - protein, 566 aa, Artificial Sequence
  hemagglutinin__InfluenzaA__ACV49512
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIESRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKDVELKSGYKDWILWISFAISCFLLCVVLLGFIMWACQRGNIRCNICI

SEQ ID NO: 3277 - protein, 566 aa, Artificial Sequence; identical to SEQ ID NO: 2329
  hemagglutinin__InfluenzaA__ACV49523

SEQ ID NO: 3278 - protein, 565 aa, Artificial Sequence
  hemagglutinin__InfluenzaA__ACV49545
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 3279 - protein, 566 aa, Artificial Sequence
  hemagglutinin__InfluenzaA__ACV49556
MKARLLILLCALAATDADTICIGYHANNSTDTVDTVLEKNVTVTHSVNLLEDSHNGKLCRLKGIAPLQLGKCNIAGWILGNPECDSLLPASSWSYIVETPNSKNGICYPGDFIDYEELREQLSSVSSFERFEIFPKESSWPKHSTTKGVTAACSHAGKSSFYRNLLWLTKKEDSYPKLSNSYVNKKGKEVLVLWGVHHPSSSKEQQTLYQNENAYVSVVSSNYNRRFIPEIAERPEVKDQAGRINYYWTLLEPGDTIIFEANGNLVAPWYAFALSRGFGSGIITSNASMHECNTKCQTPQGAINSSLPFQNIHPVTIGECPKYVKSAKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKIQLKNNAKEIGNGCFEFYHKCDNECMESVRNGTYDYPKYSKESKLNREKIDGVKLESMGVYQILAIYSTVASSLVLLVSLGAISFWMCSNGSLQCRICI

SEQ ID NO: 3280 - protein, 566 aa, Artificial Sequence
  hemagglutinin__InfluenzaA__ACV49567
MKAKLLILLCALTATDADTICIGYHANNSTDTVDTVLEKNVTVTHSVNLLEDSHNGKLCRLKGIAPLQLGKCNIAGWILGNPECESLLSKRSWSYIAETPNSENGACYPGDFADYEELREQLSSVSSFERFEIFPKERSWPKHNITRGVTAACSHAGKSSFYKNLLWLTETDGSYPKLSKSYVNNKEKEVLVLWGVHHPSNIEDQKTLYRKENAYVSVVSSNYNRRFTPEIAERPKVRGQAGRINYYWTLLEPGDTIIFEANGNLIAPWYAFALSRDFGSGIITSNASMDECDTKCQTPQGAINSSLPFQNIHPVTIGECPKYVKSTKLRMVTGLRNIPSIQSRGLFGAIAGFIEGGWTGMIDGWYGYHHQNEQGSGYAADQKSTQNAINWITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 3281 - protein, 562 aa, Artificial Sequence
  hemagglutinin__InfluenzaA__ACV49578
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPKYSLCYPGSFNDYEELKHLLSSVKHFEKVKILPKDRWTQHTTTGGSRACAVSGNPSFFRNMVWLTKKGPNYPVAKGSYNNTSGEQMLIIWGVHHPIDEAEQIALYQKVGTYVSASTSTLNKRSTPEIAARPEVNGLGSRMEFSWTLLDMWDTINFESTGNLVAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDDECMDSVKNGTYDYPKYEEESKLNRNEIKGVKLSSMGVYQILAIYATVAGSLSLAIMMAGISFWMCSNGSLQCRICI

SEQ ID NO: 3282 - protein, 562 aa, Artificial Sequence; identical to SEQ ID NO: 3281
  hemagglutinin__InfluenzaA__ACV49589

SEQ ID NO: 3283 - protein, 562 aa, Artificial Sequence
  hemagglutinin__InfluenzaA__ACV49600
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTEKGSNYPVAKGSYNNTSGEQMLIIWGVHHPNDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 3284 - protein, 562 aa, Artificial Sequence
  hemagglutinin__InfluenzaA__ACV49611
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTEKGSNYPVAKGSYNNTSGEQMLIIWGVHHPNDETEQRTLYQNVGTYVSVGTSTLNKRSTPKIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKVEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 3285 - protein, 566 aa, Artificial Sequence
  hemagglutinin__InfluenzaA__ACV49633
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSVQTSLYVQASGRVTVSTKRSQQTVIPNIGSRPWVRGISSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFPQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 3286 - protein, 566 aa, Artificial Sequence; identical to SEQ ID NO: 2356
  hemagglutinin__InfluenzaA__ACV49644

SEQ ID NO: 3287 - protein, 565 aa, Artificial Sequence; identical to SEQ ID NO: 3175
  hemagglutinin__InfluenzaA__ACV49676

SEQ ID NO: 3288 - protein, 566 aa, Artificial Sequence; identical to SEQ ID NO: 2656
  hemagglutinin__InfluenzaA__ACV53450

SEQ ID NO: 3289 - protein, 566 aa, Artificial Sequence; identical to SEQ ID NO: 2656
  hemagglutinin__InfluenzaA__ACV53460

SEQ ID NO: 3290 - protein, 566 aa, Artificial Sequence; identical to SEQ ID NO: 2656
  hemagglutinin__InfluenzaA__ACV53480

SEQ ID NO: 3291 - protein, 566 aa, Artificial Sequence
  hemagglutinin__InfluenzaA__ACV53490
MEAILVVLLYTFATANADTLCIGYHANNSTDTVDTVLEKNVTVTHSVNLLEDKHNGKLCKLRGVAPLHLGKCDIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLETRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3292 - protein, 566 aa, Artificial Sequence
  hemagglutinin__InfluenzaA__ACV53500
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLETRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3293 - protein, 566 aa, Artificial Sequence
  hemagglutinin__InfluenzaA__ACV53880
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3294 - protein, 566 aa, Artificial Sequence; identical to SEQ ID NO: 2669
  hemagglutinin__InfluenzaA__ACV53881

SEQ ID NO: 3295 - protein, 566 aa, Artificial Sequence; identical to SEQ ID NO: 2656
  hemagglutinin__InfluenzaA__ACV53882

SEQ ID NO: 3296 - protein, 566 aa, Artificial Sequence; identical to SEQ ID NO: 2669
  hemagglutinin__InfluenzaA__ACV53883

SEQ ID NO: 3297 - protein, 566 aa, Artificial Sequence; identical to SEQ ID NO: 2669
  hemagglutinin__InfluenzaA__ACV53885

SEQ ID NO: 3298 - protein, 566 aa, Artificial Sequence
  hemagglutinin__InfluenzaA__ACV53899
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3299 - protein, 566 aa, Artificial Sequence; identical to SEQ ID NO: 2669
  hemagglutinin__InfluenzaA__ACV53909

SEQ ID NO: 3300 - protein, 566 aa, Artificial Sequence; identical to SEQ ID NO: 2669
  hemagglutinin__InfluenzaA__ACV67220

SEQ ID NO: 3301 - protein, 566 aa, Artificial Sequence
  hemagglutinin__InfluenzaA__ACV67221
MKAILVVLLYTFATANADTLCIGYHANNSTDTVDTVLEKNVTVTHSVNLLEDKHNGKLCKLRGVAPLHLGKCNIAGWILGNPECGSLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQSADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3302 - protein, 566 aa, Artificial Sequence; identical to SEQ ID NO: 2656
  hemagglutinin__InfluenzaA__ACV67222

SEQ ID NO: 3303 - protein, 566 aa, Artificial Sequence; identical to SEQ ID NO: 2695
  hemagglutinin__InfluenzaA__ACV67223

SEQ ID NO: 3304 - protein, 566 aa, Artificial Sequence; identical to SEQ ID NO: 2911
  hemagglutinin__InfluenzaA__ACV67224

SEQ ID NO: 3305 - protein, 566 aa, Artificial Sequence; identical to SEQ ID NO: 2849
  hemagglutinin__InfluenzaA__ACV67225

SEQ ID NO: 3306 - protein, 566 aa, Artificial Sequence; identical to SEQ ID NO: 2669
  hemagglutinin__InfluenzaA__ACV67226

SEQ ID NO: 3307 - protein, 566 aa, Artificial Sequence
  hemagglutinin__InfluenzaA__ACV67227
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISNTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3308 - protein, 566 aa, Artificial Sequence; identical to SEQ ID NO: 2911
  hemagglutinin__InfluenzaA__ACV67228

SEQ ID NO: 3309 - protein, 566 aa, Artificial Sequence
  hemagglutinin__InfluenzaA__ACV67229
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNPIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3310 - protein, 566 aa, Artificial Sequence; identical to SEQ ID NO: 2656
  hemagglutinin__InfluenzaA__ACV67230

SEQ ID NO: 3311 - protein, 566 aa, Artificial Sequence; identical to SEQ ID NO: 2669
  hemagglutinin__InfluenzaA__ACV67231

SEQ ID NO: 3312 - protein, 566 aa, Artificial Sequence; identical to SEQ ID NO: 2669
  hemagglutinin__InfluenzaA__ACV67232

SEQ ID NO: 3313 - protein, 566 aa, Artificial Sequence; identical to SEQ ID NO: 2656
  hemagglutinin__InfluenzaA__ACV67233

SEQ ID NO: 3314 - protein, 566 aa, Artificial Sequence; identical to SEQ ID NO: 2911
  hemagglutinin__InfluenzaA__ACV67234

SEQ ID NO: 3315 - protein, 566 aa, Artificial Sequence
  hemagglutinin__InfluenzaA__ACV67235
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNANEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3316 - protein, 566 aa, Artificial Sequence; identical to SEQ ID NO: 2913
  hemagglutinin__InfluenzaA__ACV67236

SEQ ID NO: 3317 - protein, 566 aa, Artificial Sequence; identical to SEQ ID NO: 2656
  hemagglutinin__InfluenzaA__ACV67238

SEQ ID NO: 3318 - protein, 566 aa, Artificial Sequence
  hemagglutinin__InfluenzaA__ACV67239
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCNNTCMESVKNGTYDYPKYSEEAKLNREEIDGVKLESTRIYQILAIYSTVASSLVLVVSLGAISFWMCSNGSLQCRICI

SEQ ID NO: 3319 - protein, 566 aa, Artificial Sequence; identical to SEQ ID NO: 2913
  hemagglutinin__InfluenzaA__ACV67240

SEQ ID NO: 3320 - protein, 566 aa, Artificial Sequence
  hemagglutinin__InfluenzaA__ACV67241
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKNGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3321 - protein, 566 aa, Artificial Sequence; identical to SEQ ID NO: 2911
  hemagglutinin__InfluenzaA__ACV67242

SEQ ID NO: 3322 - protein, 566 aa, Artificial Sequence; identical to SEQ ID NO: 2849
  hemagglutinin__InfluenzaA__ACV67244

SEQ ID NO: 3323 - protein, 566 aa, Artificial Sequence; identical to SEQ ID NO: 2762
  hemagglutinin__InfluenzaA__ACV67246

SEQ ID NO: 3324 - protein, 566 aa, Artificial Sequence; identical to SEQ ID NO: 3293
  hemagglutinin__InfluenzaA__ACV67247

SEQ ID NO: 3325 - protein, 566 aa, Artificial Sequence; identical to SEQ ID NO: 2656
  hemagglutinin__InfluenzaA__ACV70073

SEQ ID NO: 3326 - protein, 566 aa, Artificial Sequence; identical to SEQ ID NO: 2656
  hemagglutinin__InfluenzaA__ACV70093

SEQ ID NO: 3327 - protein, 566 aa, Artificial Sequence; identical to SEQ ID NO: 2656
  hemagglutinin__InfluenzaA__ACV70103

SEQ ID NO: 3328 - protein, 566 aa, Artificial Sequence; identical to SEQ ID NO: 2656
  hemagglutinin__InfluenzaA__ACV70113

SEQ ID NO: 3329 - protein, 566 aa, Artificial Sequence; identical to SEQ ID NO: 2656
  hemagglutinin__InfluenzaA__ACV70123

SEQ ID NO: 3330 - protein, 566 aa, Artificial Sequence; identical to SEQ ID NO: 2656
  hemagglutinin__InfluenzaA__ACV70154

SEQ ID NO: 3331 - protein, 566 aa, Artificial Sequence
  hemagglutinin__InfluenzaA__ACV70164
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTLKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3332 - protein, 566 aa, Artificial Sequence; identical to SEQ ID NO: 2656
  hemagglutinin__InfluenzaA__ACV70174

SEQ ID NO: 3333 - protein, 566 aa, Artificial Sequence; identical to SEQ ID NO: 2656
  hemagglutinin__InfluenzaA__ACV70184

SEQ ID NO: 3334 - protein, 566 aa, Artificial Sequence; identical to SEQ ID NO: 2656
  hemagglutinin__InfluenzaA__ACV70194

SEQ ID NO: 3335 - protein, 566 aa, Artificial Sequence; identical to SEQ ID NO: 2656
  hemagglutinin__InfluenzaA__ACV70204

SEQ ID NO: 3336 - protein, 566 aa, Artificial Sequence; identical to SEQ ID NO: 2656
  hemagglutinin__InfluenzaA__ACV70214

SEQ ID NO: 3337 - protein, 566 aa, Artificial Sequence; identical to SEQ ID NO: 2656
  hemagglutinin__InfluenzaA__ACV70224

SEQ ID NO: 3338 - protein, 566 aa, Artificial Sequence; identical to SEQ ID NO: 2656
  hemagglutinin__InfluenzaA__ACV70234

SEQ ID NO: 3339 - protein, 566 aa, Artificial Sequence; identical to SEQ ID NO: 2656
  hemagglutinin__InfluenzaA__ACV70254

SEQ ID NO: 3340 - protein, 566 aa, Artificial Sequence; identical to SEQ ID NO: 2656
  hemagglutinin__InfluenzaA__ACV70264

SEQ ID NO: 3341 - protein, 566 aa, Artificial Sequence; identical to SEQ ID NO: 2656
  hemagglutinin__InfluenzaA__ACV70274

SEQ ID NO: 3342 - protein, 566 aa, Artificial Sequence; identical to SEQ ID NO: 2656
  hemagglutinin__InfluenzaA__ACV70284

SEQ ID NO: 3343 - protein, 566 aa, Artificial Sequence; identical to SEQ ID NO: 2656
  hemagglutinin__InfluenzaA__ACV70294

SEQ ID NO: 3344 - protein, 566 aa, Artificial Sequence; identical to SEQ ID NO: 2656
  hemagglutinin__InfluenzaA__ACV70304

SEQ ID NO: 3345 - protein, 566 aa, Artificial Sequence; identical to SEQ ID NO: 3331
  hemagglutinin__InfluenzaA__ACV70314

SEQ ID NO: 3346 - protein, 566 aa, Artificial Sequence
  hemagglutinin__InfluenzaA__ACV70324
MKAILVVLLYTFATANADTLCIGYHANNSTDTVDTVLEKNVTVTHSVNLLEDKHNGKLCKLRGVAPLHLGKCNIAGWILGNPECESLFTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3347 - protein, 566 aa, Artificial Sequence; identical to SEQ ID NO: 2656
  hemagglutinin__InfluenzaA__ACV70334

SEQ ID NO: 3348 - protein, 566 aa, Artificial Sequence; identical to SEQ ID NO: 2656
  hemagglutinin__InfluenzaA__ACV70344

SEQ ID NO: 3349 - protein, 566 aa, Artificial Sequence; identical to SEQ ID NO: 2656
  hemagglutinin__InfluenzaA__ACV70354

SEQ ID NO: 3350 - protein, 566 aa, Artificial Sequence; identical to SEQ ID NO: 2656
  hemagglutinin__InfluenzaA__ACV70364

SEQ ID NO: 3351 - protein, 566 aa, Artificial Sequence; identical to SEQ ID NO: 2656
  hemagglutinin__InfluenzaA__ACV70374

SEQ ID NO: 3352 - protein, 566 aa, Artificial Sequence; identical to SEQ ID NO: 2656
  hemagglutinin__InfluenzaA__ACV70384

SEQ ID NO: 3353 - protein, 566 aa, Artificial Sequence; identical to SEQ ID NO: 2656
  hemagglutinin__InfluenzaA__ACV70394

SEQ ID NO: 3354 - protein, 566 aa, Artificial Sequence; identical to SEQ ID NO: 2656
  hemagglutinin__InfluenzaA__ACV70404

SEQ ID NO: 3355 - protein, 566 aa, Artificial Sequence; identical to SEQ ID NO: 3331
  hemagglutinin__InfluenzaA__ACV70414

SEQ ID NO: 3356 - protein, 566 aa, Artificial Sequence; identical to SEQ ID NO: 2656
  hemagglutinin__InfluenzaA__ACV70424

SEQ ID NO: 3357 - protein, 566 aa, Artificial Sequence; identical to SEQ ID NO: 2656
  hemagglutinin__InfluenzaA__ACV70434

SEQ ID NO: 3358 - protein, 566 aa, Artificial Sequence; identical to SEQ ID NO: 2656
  hemagglutinin__InfluenzaA__ACV70444

SEQ ID NO: 3359 - protein, 566 aa, Artificial Sequence; identical to SEQ ID NO: 2656
  hemagglutinin__InfluenzaA__ACV70454

SEQ ID NO: 3360 - protein, 566 aa, Artificial Sequence; identical to SEQ ID NO: 2656
  hemagglutinin__InfluenzaA__ACV70464

SEQ ID NO: 3361 - protein, 566 aa, Artificial Sequence; identical to SEQ ID NO: 2656
  hemagglutinin__InfluenzaA__ACV70474

SEQ ID NO: 3362 - protein, 566 aa, Artificial Sequence; identical to SEQ ID NO: 2656
  hemagglutinin__InfluenzaA__ACV70484

SEQ ID NO: 3363 - protein, 566 aa, Artificial Sequence; identical to SEQ ID NO: 2656
  hemagglutinin__InfluenzaA__ACV70494

SEQ ID NO: 3364 - protein, 566 aa, Artificial Sequence; identical to SEQ ID NO: 2656
  hemagglutinin__InfluenzaA__ACV70504

SEQ ID NO: 3365 - protein, 566 aa, Artificial Sequence; identical to SEQ ID NO: 2656
  hemagglutinin__InfluenzaA__ACV70514

SEQ ID NO: 3366 - protein, 566 aa, Artificial Sequence; identical to SEQ ID NO: 2656
  hemagglutinin__InfluenzaA__ACV70524

SEQ ID NO: 3367 - protein, 566 aa, Artificial Sequence; identical to SEQ ID NO: 2849
  hemagglutinin__InfluenzaA__ACV70534

SEQ ID NO: 3368 - protein, 566 aa, Artificial Sequence; identical to SEQ ID NO: 2656
  hemagglutinin__InfluenzaA__ACV70544

SEQ ID NO: 3369 - protein, 566 aa, Artificial Sequence; identical to SEQ ID NO: 2656
  hemagglutinin__InfluenzaA__ACV70564

SEQ ID NO: 3370 - protein, 566 aa, Artificial Sequence; identical to SEQ ID NO: 2656
  hemagglutinin__InfluenzaA__ACV70584

SEQ ID NO: 3371 - protein, 566 aa, Artificial Sequence; identical to SEQ ID NO: 3331
  hemagglutinin__InfluenzaA__ACV70594

SEQ ID NO: 3372 - protein, 566 aa, Artificial Sequence; identical to SEQ ID NO: 2656
  hemagglutinin__InfluenzaA__ACV70604

SEQ ID NO: 3373 - protein, 566 aa, Artificial Sequence; identical to SEQ ID NO: 2656
  hemagglutinin__InfluenzaA__ACV70614

SEQ ID NO: 3374 - protein, 566 aa, Artificial Sequence; identical to SEQ ID NO: 2656
  hemagglutinin__InfluenzaA__ACV70624

SEQ ID NO: 3375 - protein, 566 aa, Artificial Sequence; identical to SEQ ID NO: 2656
  hemagglutinin__InfluenzaA__ACV70634

SEQ ID NO: 3376 - protein, 566 aa, Artificial Sequence; identical to SEQ ID NO: 2656
  hemagglutinin__InfluenzaA__ACV70644

SEQ ID NO: 3377 - protein, 566 aa, Artificial Sequence; identical to SEQ ID NO: 2656
  hemagglutinin__InfluenzaA__ACV70654

SEQ ID NO: 3378 - protein, 566 aa, Artificial Sequence; identical to SEQ ID NO: 2656
  hemagglutinin__InfluenzaA__ACV70664

SEQ ID NO: 3379 - protein, 566 aa, Artificial Sequence; identical to SEQ ID NO: 2656
  hemagglutinin__InfluenzaA__ACV70674

SEQ ID NO: 3380 - protein, 566 aa, Artificial Sequence; identical to SEQ ID NO: 2656
  hemagglutinin__InfluenzaA__ACV70684

SEQ ID NO: 3381 - protein, 566 aa, Artificial Sequence; identical to SEQ ID NO: 2656
  hemagglutinin__InfluenzaA__ACV70694

SEQ ID NO: 3382 - protein, 566 aa, Artificial Sequence; identical to SEQ ID NO: 2656
  hemagglutinin__InfluenzaA__ACV70704

SEQ ID NO: 3383 - protein, 566 aa, Artificial Sequence; identical to SEQ ID NO: 2656
  hemagglutinin__InfluenzaA__ACV70714

SEQ ID NO: 3384 - protein, 566 aa, Artificial Sequence; identical to SEQ ID NO: 2656
  hemagglutinin__InfluenzaA__ACV70724

SEQ ID NO: 3385 - protein, 566 aa, Artificial Sequence; identical to SEQ ID NO: 3293
  hemagglutinin__InfluenzaA__ACV70734

SEQ ID NO: 3386 - protein, 566 aa, Artificial Sequence; identical to SEQ ID NO: 2656
  hemagglutinin__InfluenzaA__ACV70744

SEQ ID NO: 3387 - protein, 566 aa, Artificial Sequence; identical to SEQ ID NO: 2656
  hemagglutinin__InfluenzaA__ACV70754

SEQ ID NO: 3388 - protein, 566 aa, Artificial Sequence; identical to SEQ ID NO: 2656
  hemagglutinin__InfluenzaA__ACV70764

SEQ ID NO: 3389 - protein, 566 aa, Artificial Sequence; identical to SEQ ID NO: 2656
  hemagglutinin__InfluenzaA__ACV70784

SEQ ID NO: 3390 - protein, 566 aa, Artificial Sequence
  hemagglutinin__InfluenzaA__ACV70794
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGATAACPHAGAKGFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3391 - protein, 566 aa, Artificial Sequence; identical to SEQ ID NO: 2656
  hemagglutinin__InfluenzaA__ACV70804

SEQ ID NO: 3392 - protein, 566 aa, Artificial Sequence; identical to SEQ ID NO: 3331
  hemagglutinin__InfluenzaA__ACV70824

SEQ ID NO: 3393 - protein, 566 aa, Artificial Sequence; identical to SEQ ID NO: 2656
  hemagglutinin__InfluenzaA__ACV70834

SEQ ID NO: 3394 - protein, 566 aa, Artificial Sequence
  hemagglutinin__InfluenzaA__ACV70844
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3395 - protein, 566 aa, Artificial Sequence; identical to SEQ ID NO: 2656
  hemagglutinin__InfluenzaA__ACV70854

SEQ ID NO: 3396 - protein, 566 aa, Artificial Sequence
  hemagglutinin__InfluenzaA__ACV70864
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGTSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3397 - protein, 566 aa, Artificial Sequence; identical to SEQ ID NO: 2656
  hemagglutinin__InfluenzaA__ACV70874

SEQ ID NO: 3398 - protein, 566 aa, Artificial Sequence; identical to SEQ ID NO: 2849
  hemagglutinin__InfluenzaA__ACV70884

SEQ ID NO: 3399 - protein, 566 aa, Artificial Sequence
  hemagglutinin__InfluenzaA__ACV70904
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3400 - protein, 566 aa, Artificial Sequence; identical to SEQ ID NO: 2656
  hemagglutinin__InfluenzaA__ACV70914

SEQ ID NO: 3401 - protein, 566 aa, Artificial Sequence; identical to SEQ ID NO: 2656
  hemagglutinin__InfluenzaA__ACV70924

SEQ ID NO: 3402 - protein, 566 aa, Artificial Sequence; identical to SEQ ID NO: 2656
  hemagglutinin__InfluenzaA__ACV70934

SEQ ID NO: 3403 - protein, 566 aa, Artificial Sequence; identical to SEQ ID NO: 2656
  hemagglutinin__InfluenzaA__ACV70944

SEQ ID NO: 3404 - protein, 566 aa, Artificial Sequence
  hemagglutinin__InfluenzaA__ACV70954
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3405 - protein, 566 aa, Artificial Sequence; identical to SEQ ID NO: 2656
  hemagglutinin__InfluenzaA__ACV70964

SEQ ID NO: 3406 - protein, 566 aa, Artificial Sequence; identical to SEQ ID NO: 2656
  hemagglutinin__InfluenzaA__ACV70974

SEQ ID NO: 3407 - protein, 566 aa, Artificial Sequence; identical to SEQ ID NO: 3399
  hemagglutinin__InfluenzaA__ACV70984

SEQ ID NO: 3408 - protein, 566 aa, Artificial Sequence; identical to SEQ ID NO: 3404
  hemagglutinin__InfluenzaA__ACV70994

SEQ ID NO: 3409 - protein, 566 aa, Artificial Sequence; identical to SEQ ID NO: 2656
  hemagglutinin__InfluenzaA__ACV71004

SEQ ID NO: 3410 - protein, 566 aa, Artificial Sequence
  hemagglutinin__InfluenzaA__ACV82230
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSQAYSNCYPYDVPDYASLRSLVASSGTLEFNNESFNWTGVTQNGTSSACIRRSKNSFFSRLNWLTHLNFKYQALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3411 - protein, 566 aa, Artificial Sequence
  hemagglutinin__InfluenzaA__ACV82232
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3412 - protein, 565 aa, Artificial Sequence
  hemagglutinin__InfluenzaA__ACV82233
MKVKLLVLLCTFTATYADTICIGYHANNSTDTVDTVLEKNVTVTHSVNLLENNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKIRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3413 - protein, 566 aa, Artificial Sequence
  hemagglutinin__InfluenzaA__ACV83662
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3414 - protein, 566 aa, Artificial Sequence
  hemagglutinin__InfluenzaA__ACV83663
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3415 - protein, 566 aa, Artificial Sequence; identical to SEQ ID NO: 3414
  hemagglutinin__InfluenzaA__ACV83664

SEQ ID NO: 3416 - protein, 566 aa, Artificial Sequence
  hemagglutinin__InfluenzaA__ACV83665
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTIADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3417 - protein, 566 aa, Artificial Sequence
  hemagglutinin__InfluenzaA__ACV83667
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3418 - protein, 566 aa, Artificial Sequence; identical to SEQ ID NO: 2669
  hemagglutinin__InfluenzaA__ACV83668

SEQ ID NO: 3419 - protein, 566 aa, Artificial Sequence; identical to SEQ ID NO: 2669
  hemagglutinin__InfluenzaA__ACV83670

SEQ ID NO: 3420 - protein, 566 aa, Artificial Sequence; identical to SEQ ID NO: 2911
  hemagglutinin__InfluenzaA__ACV83671

SEQ ID NO: 3421 - protein, 566 aa, Artificial Sequence; identical to SEQ ID NO: 3231
  hemagglutinin__InfluenzaA__ACV88399

SEQ ID NO: 3422 - protein, 566 aa, Artificial Sequence; identical to SEQ ID NO: 3231
  hemagglutinin__InfluenzaA__ACV88409

SEQ ID NO: 3423 - protein, 566 aa, Artificial Sequence; identical to SEQ ID NO: 2656
  hemagglutinin__InfluenzaA__ACV88419

SEQ ID NO: 3424 - protein, 565 aa, Artificial Sequence; identical to SEQ ID NO: 3278
  hemagglutinin__InfluenzaA__ACV89502

SEQ ID NO: 3425 - protein, 566 aa, Artificial Sequence
  hemagglutinin__InfluenzaA__ACV89516
MKARLLILLCALAATDADTICIGYHANNSTDTVDTVLEKNVTVTHSVNLLEDSHNGKLCRLKGIAPLQLGKCNIAGWILGNPECDSLLPASSWSYIVETPNSKNGICYPGDFIDYEELREQLSSVSSFERFEIFPKESSWPKHSTTKGVTAACSHAGKSSFYRNLLWLTKKGDSYPKLSNSYVNKKGKEVLVLWGVHHPSSSKEQQTLYQNENAYVSVVSSNYNRRFIPEIAERPEVKDQAGRINYYWTLLEPGDTIIFEANGNLVAPWYAFALSRGFGSGIITSNASMHECNTKCQTPQGAINSSLPFQNIHPVTIGECPKYVKSAKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDSNVKNLYEKVKIQLKNNAKEIGNGCFEFYHKCDNECMESVRNGTYDYPKYSKESKLNREKIDGVKLESMGVYQILAIYSTVASSLVLLVSLGAISFWMCSNGSLQCRICI

SEQ ID NO: 3426 - protein, 565 aa, Artificial Sequence
  hemagglutinin__InfluenzaA__ACV90512
MNVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPIDKWDAKCQTPQGAINSSLPFQNVHPVTIGEWPKYVRSAKLRMVTGLRNIPSIQSRGLFGAIAGFIEGGWTGMVDGWYGYHHQNEQGSGYAADQKSTQNAINGITNKMNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVTLESMGVYQILAIYSTVASSLVLLVSLGAISFWMCSNGSLQCRICI

SEQ ID NO: 3427 - protein, 566 aa, Artificial Sequence; identical to SEQ ID NO: 2669
  hemagglutinin__InfluenzaA__ACV91672

SEQ ID NO: 3428 - protein, 566 aa, Artificial Sequence; identical to SEQ ID NO: 2669
  hemagglutinin__InfluenzaA__ACV91676

SEQ ID NO: 3429 - protein, 566 aa, Artificial Sequence; identical to SEQ ID NO: 2669
  hemagglutinin__InfluenzaA__ACV91680

SEQ ID NO: 3430 - protein, 566 aa, Artificial Sequence
  hemagglutinin__InfluenzaA__ACX31591
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYQALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3431 - protein, 566 aa, Artificial Sequence
  hemagglutinin__InfluenzaA__ACX31933
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 3432 - protein, 566 aa, Artificial Sequence
  hemagglutinin__InfluenzaA__ACX31934
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEITIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3433 - protein, 566 aa, Artificial Sequence; identical to SEQ ID NO: 2669
  hemagglutinin__InfluenzaA__ACX31935

SEQ ID NO: 3434 - protein, 566 aa, Artificial Sequence; identical to SEQ ID NO: 2669
  hemagglutinin__InfluenzaA__ACX31936

SEQ ID NO: 3435 - protein, 566 aa, Artificial Sequence; identical to SEQ ID NO: 2760
  hemagglutinin__InfluenzaA__ACX31939

SEQ ID NO: 3436 - protein, 566 aa, Artificial Sequence; identical to SEQ ID NO: 2760
  hemagglutinin__InfluenzaA__ACX31940

SEQ ID NO: 3437 - protein, 566 aa, Artificial Sequence; identical to SEQ ID NO: 2669
  hemagglutinin__InfluenzaA__ACX31943

SEQ ID NO: 3438 - protein, 566 aa, Artificial Sequence; identical to SEQ ID NO: 2669
  hemagglutinin__InfluenzaA__ACX31946

SEQ ID NO: 3439 - protein, 566 aa, Artificial Sequence; identical to SEQ ID NO: 2669
  hemagglutinin__InfluenzaA__ACX31947

SEQ ID NO: 3440 - protein, 566 aa, Artificial Sequence; identical to SEQ ID NO: 2669
  hemagglutinin__InfluenzaA__ACX31948

SEQ ID NO: 3441 - protein, 566 aa, Artificial Sequence
  hemagglutinin__InfluenzaA__ACX31949
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHYCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEEVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3442 - protein, 566 aa, Artificial Sequence; identical to SEQ ID NO: 2669
  hemagglutinin__InfluenzaA__ACX31950

SEQ ID NO: 3443 - protein, 566 aa, Artificial Sequence; identical to SEQ ID NO: 2669
  hemagglutinin__InfluenzaA__ACX31951

SEQ ID NO: 3444 - protein, 566 aa, Artificial Sequence; identical to SEQ ID NO: 2669
  hemagglutinin__InfluenzaA__ACX31954

SEQ ID NO: 3445 - protein, 566 aa, Artificial Sequence; identical to SEQ ID NO: 2669
  hemagglutinin__InfluenzaA__ACX31955

SEQ ID NO: 3446 - protein, 566 aa, Artificial Sequence; identical to SEQ ID NO: 2656
  hemagglutinin__InfluenzaA__ACX31956

SEQ ID NO: 3447 - protein, 566 aa, Artificial Sequence; identical to SEQ ID NO: 2669
  hemagglutinin__InfluenzaA__ACX31957

SEQ ID NO: 3448 - protein, 566 aa, Artificial Sequence; identical to SEQ ID NO: 2656
  hemagglutinin__InfluenzaA__ACX31958

SEQ ID NO: 3449 - protein, 566 aa, Artificial Sequence; identical to SEQ ID NO: 2911
  hemagglutinin__InfluenzaA__ACX31960

SEQ ID NO: 3450 - protein, 566 aa, Artificial Sequence
  hemagglutinin__InfluenzaA__ACX31961
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFMDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3451 - protein, 566 aa, Artificial Sequence; identical to SEQ ID NO: 2669
  hemagglutinin__InfluenzaA__ACX31962

SEQ ID NO: 3452 - protein, 566 aa, Artificial Sequence; identical to SEQ ID NO: 2669
  hemagglutinin__InfluenzaA__ACX31964

SEQ ID NO: 3453 - protein, 566 aa, Artificial Sequence; identical to SEQ ID NO: 2656
  hemagglutinin__InfluenzaA__ACX35237

SEQ ID NO: 3454 - protein, 566 aa, Artificial Sequence; identical to SEQ ID NO: 2669
  hemagglutinin__InfluenzaA__ACX35247

SEQ ID NO: 3455 - protein, 566 aa, Artificial Sequence; identical to SEQ ID NO: 2669
  hemagglutinin__InfluenzaA__ACX35257

SEQ ID NO: 3456 - protein, 566 aa, Artificial Sequence; identical to SEQ ID NO: 2669
  hemagglutinin__InfluenzaA__ACX35267

SEQ ID NO: 3457 - protein, 566 aa, Artificial Sequence; identical to SEQ ID NO: 2669
  hemagglutinin__InfluenzaA__ACX35277

SEQ ID NO: 3458 - protein, 566 aa, Artificial Sequence; identical to SEQ ID NO: 2669
  hemagglutinin__InfluenzaA__ACX35287

SEQ ID NO: 3459 - protein, 566 aa, Artificial Sequence; identical to SEQ ID NO: 2669
  hemagglutinin__InfluenzaA__ACX35297

SEQ ID NO: 3460 - protein, 566 aa, Artificial Sequence
  hemagglutinin__InfluenzaA__ACX35307
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVGPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3461 - protein, 566 aa, Artificial Sequence; identical to SEQ ID NO: 2911
  hemagglutinin__InfluenzaA__ACX35317

SEQ ID NO: 3462 - protein, 566 aa, Artificial Sequence
  hemagglutinin__InfluenzaA__ACX35327
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3463 - protein, 566 aa, Artificial Sequence
  hemagglutinin__InfluenzaA__ACX36501
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSIYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3464 - protein, 566 aa, Artificial Sequence
  hemagglutinin__InfluenzaA__ACX36502
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSIYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3465 - protein, 566 aa, Artificial Sequence
  hemagglutinin__InfluenzaA__ACX36503
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSIYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNTKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3466 - protein, 566 aa, Artificial Sequence
  hemagglutinin__InfluenzaA__ACX47367
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3467 - protein, 566 aa, Artificial Sequence
  hemagglutinin__InfluenzaA__ACX47368
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3468 - protein, 566 aa, Artificial Sequence; identical to SEQ ID NO: 3467
  hemagglutinin__InfluenzaA__ACX47369

SEQ ID NO: 3469 - protein, 566 aa, Artificial Sequence
  hemagglutinin__InfluenzaA__ACX47370
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADRQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3470 - protein, 566 aa, Artificial Sequence; identical to SEQ ID NO: 3467
  hemagglutinin__InfluenzaA__ACX47371

SEQ ID NO: 3471 - protein, 566 aa, Artificial Sequence; identical to SEQ ID NO: 3467
  hemagglutinin__InfluenzaA__ACX47372

SEQ ID NO: 3472 - protein, 566 aa, Artificial Sequence; identical to SEQ ID NO: 3467
  hemagglutinin__InfluenzaA__ACX47373

SEQ ID NO: 3473 - protein, 566 aa, Artificial Sequence; identical to SEQ ID NO: 3467
  hemagglutinin__InfluenzaA__ACX47374

SEQ ID NO: 3474 - protein, 566 aa, Artificial Sequence
  hemagglutinin__InfluenzaA__ACX47375
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3475 - protein, 566 aa, Artificial Sequence; identical to SEQ ID NO: 3467
  hemagglutinin__InfluenzaA__ACX47376

SEQ ID NO: 3476 - protein, 566 aa, Artificial Sequence; identical to SEQ ID NO: 3467
  hemagglutinin__InfluenzaA__ACX47377

SEQ ID NO: 3477 - protein, 566 aa, Artificial Sequence
  hemagglutinin__InfluenzaA__ACX47380
MKAILVVLLYTFATANADTLCIGYHANNSTDTVDTVLEKNVTVTHSVNLLEDKHNGKLCKLRGVAPLHLGKCNIAGWILGNPECESLSTTSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFVMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3478 - protein, 566 aa, Artificial Sequence; identical to SEQ ID NO: 3477
  hemagglutinin__InfluenzaA__ACX47381

SEQ ID NO: 3479 - protein, 566 aa, Artificial Sequence; identical to SEQ ID NO: 3477
  hemagglutinin__InfluenzaA__ACX47382

SEQ ID NO: 3480 - protein, 566 aa, Artificial Sequence
  hemagglutinin__InfluenzaA__ACX47383
MKAILVVLLYTFATANADTLCIGYHANNSTDTVDTVLEKNVTVTHSVNLLEDKHNGKLCKLRGVAPLHLGKCNIAGWILGNPECESLSTTSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 3481 - protein, 566 aa, Artificial Sequence
  hemagglutinin__InfluenzaA__ACX47384
MKAILVVLLYTFATANADTLCIGYHANNSTDTVDTVLEKNVTVTHSVNLLEDKHNGKLCKLRGVAPLHLGKCNIAGWILGNPECESLSTTSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3482 - protein, 566 aa, Artificial Sequence; identical to SEQ ID NO: 3481
  hemagglutinin__InfluenzaA__ACX47385

SEQ ID NO: 3483 - protein, 566 aa, Artificial Sequence; identical to SEQ ID NO: 3481
  hemagglutinin__InfluenzaA__ACX47387

SEQ ID NO: 3484 - protein, 566 aa, Artificial Sequence; identical to SEQ ID NO: 2669
  hemagglutinin__InfluenzaA__ACX55834

SEQ ID NO: 3485 - protein, 566 aa, Artificial Sequence; identical to SEQ ID NO: 3467
  hemagglutinin__InfluenzaA__ACX61574

SEQ ID NO: 3486 - protein, 566 aa, Artificial Sequence; identical to SEQ ID NO: 2669
  hemagglutinin__InfluenzaA__ACX61575

SEQ ID NO: 3487 - protein, 566 aa, Artificial Sequence
  hemagglutinin__InfluenzaA__ACX83577
MKAILVVLLYTFATANADTLCIGYHANNSTDTVDTVLEKNVTVTHSVNLLEDKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3488 - protein, 566 aa, Artificial Sequence
  hemagglutinin__InfluenzaA__ACX94091
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTISWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCSKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3489 - protein, 566 aa, Artificial Sequence
  hemagglutinin__InfluenzaA__ACY26192
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQDAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3490 - protein, 566 aa, Artificial Sequence; identical to SEQ ID NO: 3238
  hemagglutinin__InfluenzaA__ACY26202

SEQ ID NO: 3491 - protein, 566 aa, Artificial Sequence; identical to SEQ ID NO: 2669
  hemagglutinin__InfluenzaA__ACY46103

SEQ ID NO: 3492 - protein, 566 aa, Artificial Sequence; identical to SEQ ID NO: 2669
  hemagglutinin__InfluenzaA__ACY46113

SEQ ID NO: 3493 - protein, 566 aa, Artificial Sequence
  hemagglutinin__InfluenzaA__ACY46123
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVGDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3494 - protein, 566 aa, Artificial Sequence; identical to SEQ ID NO: 2669
  hemagglutinin__InfluenzaA__ACY46133

SEQ ID NO: 3495 - protein, 566 aa, Artificial Sequence; identical to SEQ ID NO: 2669
  hemagglutinin__InfluenzaA__ACY46163

SEQ ID NO: 3496 - protein, 566 aa, Artificial Sequence
  hemagglutinin__InfluenzaA__ACY46173
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3497 - protein, 566 aa, Artificial Sequence; identical to SEQ ID NO: 2669
  hemagglutinin__InfluenzaA__ACY46213

SEQ ID NO: 3498 - protein, 566 aa, Artificial Sequence; identical to SEQ ID NO: 2669
  hemagglutinin__InfluenzaA__ACY46223

SEQ ID NO: 3499 - protein, 566 aa, Artificial Sequence; identical to SEQ ID NO: 2669
  hemagglutinin__InfluenzaA__ACY46233

SEQ ID NO: 3500 - protein, 566 aa, Artificial Sequence; identical to SEQ ID NO: 2669
  hemagglutinin__InfluenzaA__ACY46243

SEQ ID NO: 3501 - protein, 566 aa, Artificial Sequence; identical to SEQ ID NO: 2669
  hemagglutinin__InfluenzaA__ACY46253

SEQ ID NO: 3502 - protein, 566 aa, Artificial Sequence; identical to SEQ ID NO: 2669
  hemagglutinin__InfluenzaA__ACY46263

SEQ ID NO: 3503 - protein, 566 aa, Artificial Sequence; identical to SEQ ID NO: 2669
  hemagglutinin__InfluenzaA__ACY46273

SEQ ID NO: 3504 - protein, 566 aa, Artificial Sequence; identical to SEQ ID NO: 2669
  hemagglutinin__InfluenzaA__ACY46283

SEQ ID NO: 3505 - protein, 566 aa, Artificial Sequence
  hemagglutinin__InfluenzaA__ACY46293
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLAAGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3506 - protein, 566 aa, Artificial Sequence; identical to SEQ ID NO: 2669
  hemagglutinin__InfluenzaA__ACY46303

SEQ ID NO: 3507 - protein, 566 aa, Artificial Sequence; identical to SEQ ID NO: 2669
  hemagglutinin__InfluenzaA__ACY46313

SEQ ID NO: 3508 - protein, 566 aa, Artificial Sequence; identical to SEQ ID NO: 2669
  hemagglutinin__InfluenzaA__ACY46323

SEQ ID NO: 3509 - protein, 566 aa, Artificial Sequence; identical to SEQ ID NO: 2669
  hemagglutinin__InfluenzaA__ACY46343

SEQ ID NO: 3510 - protein, 566 aa, Artificial Sequence; identical to SEQ ID NO: 2669
  hemagglutinin__InfluenzaA__ACY46353

SEQ ID NO: 3511 - protein, 566 aa, Artificial Sequence
  hemagglutinin__InfluenzaA__ACY46373
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3512 - protein, 566 aa, Artificial Sequence
  hemagglutinin__InfluenzaA__ACY46383
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3513 - protein, 566 aa, Artificial Sequence; identical to SEQ ID NO: 2669
  hemagglutinin__InfluenzaA__ACY46393

SEQ ID NO: 3514 - protein, 566 aa, Artificial Sequence; identical to SEQ ID NO: 2669
  hemagglutinin__InfluenzaA__ACY46403

SEQ ID NO: 3515 - protein, 566 aa, Artificial Sequence; identical to SEQ ID NO: 2669
  hemagglutinin__InfluenzaA__ACY46413

SEQ ID NO: 3516 - protein, 566 aa, Artificial Sequence; identical to SEQ ID NO: 2669
  hemagglutinin__InfluenzaA__ACY46433

SEQ ID NO: 3517 - protein, 566 aa, Artificial Sequence; identical to SEQ ID NO: 2669
  hemagglutinin__InfluenzaA__ACY46443

SEQ ID NO: 3518 - protein, 566 aa, Artificial Sequence; identical to SEQ ID NO: 2669
  hemagglutinin__InfluenzaA__ACY46453

SEQ ID NO: 3519 - protein, 566 aa, Artificial Sequence
  hemagglutinin__InfluenzaA__ACY46463
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3520 - protein, 566 aa, Artificial Sequence; identical to SEQ ID NO: 2669
  hemagglutinin__InfluenzaA__ACY46473

SEQ ID NO: 3521 - protein, 566 aa, Artificial Sequence; identical to SEQ ID NO: 2656
  hemagglutinin__InfluenzaA__ACY46493

SEQ ID NO: 3522 - protein, 566 aa, Artificial Sequence
  hemagglutinin__InfluenzaA__ACY46513
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLDNERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3523 - protein, 566 aa, Artificial Sequence; identical to SEQ ID NO: 2669
  hemagglutinin__InfluenzaA__ACY46523

SEQ ID NO: 3524 - protein, 566 aa, Artificial Sequence; identical to SEQ ID NO: 2669
  hemagglutinin__InfluenzaA__ACY46533

SEQ ID NO: 3525 - protein, 566 aa, Artificial Sequence; identical to SEQ ID NO: 2669
  hemagglutinin__InfluenzaA__ACY46562

SEQ ID NO: 3526 - protein, 566 aa, Artificial Sequence; identical to SEQ ID NO: 2669
  hemagglutinin__InfluenzaA__ACY46572

SEQ ID NO: 3527 - protein, 566 aa, Artificial Sequence; identical to SEQ ID NO: 2669
  hemagglutinin__InfluenzaA__ACY46582

SEQ ID NO: 3528 - protein, 566 aa, Artificial Sequence; identical to SEQ ID NO: 2669
  hemagglutinin__InfluenzaA__ACY46592

SEQ ID NO: 3529 - protein, 566 aa, Artificial Sequence; identical to SEQ ID NO: 2669
  hemagglutinin__InfluenzaA__ACY46622

SEQ ID NO: 3530 - protein, 566 aa, Artificial Sequence
  hemagglutinin__InfluenzaA__ACY46672
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3531 - protein, 566 aa, Artificial Sequence; identical to SEQ ID NO: 2669
  hemagglutinin__InfluenzaA__ACY46682

SEQ ID NO: 3532 - protein, 566 aa, Artificial Sequence; identical to SEQ ID NO: 2669
  hemagglutinin__InfluenzaA__ACY46692

SEQ ID NO: 3533 - protein, 566 aa, Artificial Sequence; identical to SEQ ID NO: 2669
  hemagglutinin__InfluenzaA__ACY46712

SEQ ID NO: 3534 - protein, 566 aa, Artificial Sequence
  hemagglutinin__InfluenzaA__ACY46722
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSAGQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3535 - protein, 566 aa, Artificial Sequence
  hemagglutinin__InfluenzaA__ACY46742
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3536 - protein, 566 aa, Artificial Sequence; identical to SEQ ID NO: 2669
  hemagglutinin__InfluenzaA__ACY46762

SEQ ID NO: 3537 - protein, 566 aa, Artificial Sequence; identical to SEQ ID NO: 2669
  hemagglutinin__InfluenzaA__ACY46772

SEQ ID NO: 3538 - protein, 566 aa, Artificial Sequence; identical to SEQ ID NO: 2669
  hemagglutinin__InfluenzaA__ACY46903

SEQ ID NO: 3539 - protein, 566 aa, Artificial Sequence; identical to SEQ ID NO: 2695
  hemagglutinin__InfluenzaA__ACY77534

SEQ ID NO: 3540 - protein, 565 aa, Artificial Sequence
  hemagglutinin__InfluenzaA__ACY77544
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTTVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSWSLQCRICI

SEQ ID NO: 3541 - protein, 565 aa, Artificial Sequence
  hemagglutinin__InfluenzaA__ACY77554
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHLQCRICI

SEQ ID NO: 3542 - protein, 564 aa, Artificial Sequence
  hemagglutinin__InfluenzaA__ACY77573
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQSAIDEITNKVNSVIEKMNTQLTGQCKEFNHLEKRIENLNKKVDDGFLDIWTYNAELLVLLENERTLDYHDSNVKNLYEKVRSQLKNNANEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 3543 - protein, 566 aa, Artificial Sequence
  hemagglutinin__InfluenzaA__ACY77593
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTTVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3544 - protein, 565 aa, Artificial Sequence
  hemagglutinin__InfluenzaA__ACY77603
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSWSLQCRICI

SEQ ID NO: 3545 - protein, 564 aa, Artificial Sequence
  hemagglutinin__InfluenzaA__ACY77613
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTGQCKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 3546 - protein, 566 aa, Artificial Sequence; identical to SEQ ID NO: 2669
  hemagglutinin__InfluenzaA__ACY77623

SEQ ID NO: 3547 - protein, 568 aa, Artificial Sequence
  hemagglutinin__InfluenzaA__ACY77653
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSGHSGSLQCRICI

SEQ ID NO: 3548 - protein, 565 aa, Artificial Sequence
  hemagglutinin__InfluenzaA__ACY77663
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSWSLLCRICI

SEQ ID NO: 3549 - protein, 565 aa, Artificial Sequence
  hemagglutinin__InfluenzaA__ACY77683
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSWSLQCRICI

SEQ ID NO: 3550 - protein, 565 aa, Artificial Sequence
  hemagglutinin__InfluenzaA__ACY77693
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEITIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTGQCKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSWSLQCRICI

SEQ ID NO: 3551 - protein, 565 aa, Artificial Sequence
  hemagglutinin__InfluenzaA__ACY77703
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTGQCKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSWSLQCRICI

SEQ ID NO: 3552 - protein, 565 aa, Artificial Sequence
  hemagglutinin__InfluenzaA__ACY77713
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTGQCKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSGHLQCRICI

SEQ ID NO: 3553 - protein, 566 aa, Artificial Sequence; identical to SEQ ID NO: 2982
  hemagglutinin__InfluenzaA__ACY77723

SEQ ID NO: 3554 - protein, 564 aa, Artificial Sequence
  hemagglutinin__InfluenzaA__ACY77733
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKTGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGLQCRICI

SEQ ID NO: 3555 - protein, 565 aa, Artificial Sequence
  hemagglutinin__InfluenzaA__ACY77743
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSWSLQCRICI

SEQ ID NO: 3556 - protein, 566 aa, Artificial Sequence; identical to SEQ ID NO: 2669
  hemagglutinin__InfluenzaA__ACY77753

SEQ ID NO: 3557 - protein, 564 aa, Artificial Sequence
  hemagglutinin__InfluenzaA__ACY77783
MKAILVVLLYTFATANADTLCIGYHANNSTDTVDTVLEKNVTVTHSVNLLGDKHNGKLCKLRGVAPLHLGKCNIAGWILGNPECESLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKSLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 3558 - protein, 565 aa, Artificial Sequence
  hemagglutinin__InfluenzaA__ACY77813
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTGQCKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHLQCRICI

SEQ ID NO: 3559 - protein, 565 aa, Artificial Sequence
  hemagglutinin__InfluenzaA__ACY77823
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTGQCKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSWSLQCRICI

SEQ ID NO: 3560 - protein, 565 aa, Artificial Sequence
  hemagglutinin__InfluenzaA__ACY77833
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSWSLQCRICI

SEQ ID NO: 3561 - protein, 565 aa, Artificial Sequence
  hemagglutinin__InfluenzaA__ACY77843
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTTVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHLQCRICI

SEQ ID NO: 3562 - protein, 566 aa, Artificial Sequence
  hemagglutinin__InfluenzaA__ACY77863
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGMSLQCRICI

SEQ ID NO: 3563 - protein, 566 aa, Artificial Sequence; identical to SEQ ID NO: 2656
  hemagglutinin__InfluenzaA__ACY77874

SEQ ID NO: 3564 - protein, 566 aa, Artificial Sequence; identical to SEQ ID NO: 2656
  hemagglutinin__InfluenzaA__ACY77884

SEQ ID NO: 3565 - protein, 566 aa, Artificial Sequence
  hemagglutinin__InfluenzaA__ACY77904
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKHVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3566 - protein, 566 aa, Artificial Sequence; identical to SEQ ID NO: 2849
  hemagglutinin__InfluenzaA__ACY77914

SEQ ID NO: 3567 - protein, 566 aa, Artificial Sequence
  hemagglutinin__InfluenzaA__ACY77924
MKAILVVLLYTFATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3568 - protein, 566 aa, Artificial Sequence; identical to SEQ ID NO: 3417
  hemagglutinin__InfluenzaA__ACY77934

SEQ ID NO: 3569 - protein, 566 aa, Artificial Sequence
  hemagglutinin__InfluenzaA__ACY77944
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAESGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3570 - protein, 566 aa, Artificial Sequence; identical to SEQ ID NO: 2656
  hemagglutinin__InfluenzaA__ACY77954

SEQ ID NO: 3571 - protein, 566 aa, Artificial Sequence; identical to SEQ ID NO: 2656
  hemagglutinin__InfluenzaA__ACY77964

SEQ ID NO: 3572 - protein, 566 aa, Artificial Sequence; identical to SEQ ID NO: 2656
  hemagglutinin__InfluenzaA__ACY77974

SEQ ID NO: 3573 - protein, 566 aa, Artificial Sequence; identical to SEQ ID NO: 2656
  hemagglutinin__InfluenzaA__ACY77984

SEQ ID NO: 3574 - protein, 566 aa, Artificial Sequence; identical to SEQ ID NO: 2656
  hemagglutinin__InfluenzaA__ACY77994

SEQ ID NO: 3575 - protein, 566 aa, Artificial Sequence
  hemagglutinin__InfluenzaA__ACY79633
MKEILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNARSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3576 - protein, 566 aa, Artificial Sequence; identical to SEQ ID NO: 3467
  hemagglutinin__InfluenzaA__ACZ01953

SEQ ID NO: 3577 - protein, 566 aa, Artificial Sequence
  hemagglutinin__InfluenzaA__ACZ05050
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3578 - protein, 566 aa, Artificial Sequence
  hemagglutinin__InfluenzaA__ACZ05061
MEAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTLKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3579 - protein, 566 aa, Artificial Sequence; identical to SEQ ID NO: 2656
  hemagglutinin__InfluenzaA__ACZ05071

SEQ ID NO: 3580 - protein, 566 aa, Artificial Sequence; identical to SEQ ID NO: 2656
  hemagglutinin__InfluenzaA__ACZ05081

SEQ ID NO: 3581 - protein, 566 aa, Artificial Sequence; identical to SEQ ID NO: 2656
  hemagglutinin__InfluenzaA__ACZ05091

SEQ ID NO: 3582 - protein, 566 aa, Artificial Sequence; identical to SEQ ID NO: 2656
  hemagglutinin__InfluenzaA__ACZ05101

SEQ ID NO: 3583 - protein, 566 aa, Artificial Sequence; identical to SEQ ID NO: 2656
  hemagglutinin__InfluenzaA__ACZ05111

SEQ ID NO: 3584 - protein, 566 aa, Artificial Sequence
  hemagglutinin__InfluenzaA__ACZ05121
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYNNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMGSVKNGTYDYPKYSEEAKLNREEIDGVKLESTRIYQILAIYSTVASSLVLVVSLGAISFWMCSNGSLQCRICI

SEQ ID NO: 3585 - protein, 566 aa, Artificial Sequence; identical to SEQ ID NO: 2656
  hemagglutinin__InfluenzaA__ACZ05131

SEQ ID NO: 3586 - protein, 566 aa, Artificial Sequence; identical to SEQ ID NO: 2656
  hemagglutinin__InfluenzaA__ACZ05141

SEQ ID NO: 3587 - protein, 566 aa, Artificial Sequence; identical to SEQ ID NO: 2656
  hemagglutinin__InfluenzaA__ACZ05151

SEQ ID NO: 3588 - protein, 566 aa, Artificial Sequence
  hemagglutinin__InfluenzaA__ACZ05172
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQDGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3589 - protein, 565 aa, Artificial Sequence; identical to SEQ ID NO: 3131
  hemagglutinin__InfluenzaA__ACZ05194

SEQ ID NO: 3590 - protein, 566 aa, Artificial Sequence; identical to SEQ ID NO: 3588
  hemagglutinin__InfluenzaA__ACZ05205

SEQ ID NO: 3591 - protein, 566 aa, Artificial Sequence
  hemagglutinin__InfluenzaA__ACZ05216
MKTIIALSYILCLVFAQKIPGNDNNTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3592 - protein, 566 aa, Artificial Sequence; identical to SEQ ID NO: 3588
  hemagglutinin__InfluenzaA__ACZ05227

SEQ ID NO: 3593 - protein, 566 aa, Artificial Sequence
  hemagglutinin__InfluenzaA__ACZ05238
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWAGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3594 - protein, 566 aa, Artificial Sequence; identical to SEQ ID NO: 3588
  hemagglutinin__InfluenzaA__ACZ05249

SEQ ID NO: 3595 - protein, 566 aa, Artificial Sequence; identical to SEQ ID NO: 3588
  hemagglutinin__InfluenzaA__ACZ05260

SEQ ID NO: 3596 - protein, 566 aa, Artificial Sequence
  hemagglutinin__InfluenzaA__ACZ05271
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3597 - protein, 566 aa, Artificial Sequence
  hemagglutinin__InfluenzaA__ACZ05282
MKTTIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3598 - protein, 566 aa, Artificial Sequence; identical to SEQ ID NO: 3588
  hemagglutinin__InfluenzaA__ACZ05304

SEQ ID NO: 3599 - protein, 566 aa, Artificial Sequence; identical to SEQ ID NO: 3411
  hemagglutinin__InfluenzaA__ACZ05315

SEQ ID NO: 3600 - protein, 566 aa, Artificial Sequence; identical to SEQ ID NO: 3588
  hemagglutinin__InfluenzaA__ACZ05326

SEQ ID NO: 3601 - protein, 566 aa, Artificial Sequence
  hemagglutinin__InfluenzaA__ACZ05337
MKTIIALSYILCLVFTQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNERFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLISSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGFKDWILWISFAISCFLLCVALLGFIMWACQKGNIRCNICI

SEQ ID NO: 3602 - protein, 566 aa, Artificial Sequence; identical to SEQ ID NO: 3588
  hemagglutinin__InfluenzaA__ACZ05348

SEQ ID NO: 3603 - protein, 566 aa, Artificial Sequence; identical to SEQ ID NO: 3593
  hemagglutinin__InfluenzaA__ACZ05359

SEQ ID NO: 3604 - protein, 566 aa, Artificial Sequence; identical to SEQ ID NO: 3588
  hemagglutinin__InfluenzaA__ACZ05370

SEQ ID NO: 3605 - protein, 566 aa, Artificial Sequence
  hemagglutinin__InfluenzaA__ACZ05392
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGASSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3606 - protein, 566 aa, Artificial Sequence; identical to SEQ ID NO: 3588
  hemagglutinin__InfluenzaA__ACZ05403

SEQ ID NO: 3607 - protein, 566 aa, Artificial Sequence
  hemagglutinin__InfluenzaA__ACZ05436
MKTIIALSYILCLVFAQKLPGNDNSTATLCLGHHAVPNGTIVKTITNDQIEVTNATELVQSSSTGEICDSPHQILDGKSCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3608 - protein, 566 aa, Artificial Sequence; identical to SEQ ID NO: 3588
  hemagglutinin__InfluenzaA__ACZ05458

SEQ ID NO: 3609 - protein, 566 aa, Artificial Sequence; identical to SEQ ID NO: 3588
  hemagglutinin__InfluenzaA__ACZ05469

SEQ ID NO: 3610 - protein, 566 aa, Artificial Sequence; identical to SEQ ID NO: 3607
  hemagglutinin__InfluenzaA__ACZ05480

SEQ ID NO: 3611 - protein, 566 aa, Artificial Sequence; identical to SEQ ID NO: 3411
  hemagglutinin__InfluenzaA__ACZ05513

SEQ ID NO: 3612 - protein, 566 aa, Artificial Sequence; identical to SEQ ID NO: 3588
  hemagglutinin__InfluenzaA__ACZ05524

SEQ ID NO: 3613 - protein, 566 aa, Artificial Sequence
  hemagglutinin__InfluenzaA__ACZ05535
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3614 - protein, 566 aa, Artificial Sequence; identical to SEQ ID NO: 3613
  hemagglutinin__InfluenzaA__ACZ05546

SEQ ID NO: 3615 - protein, 566 aa, Artificial Sequence; identical to SEQ ID NO: 3588
  hemagglutinin__InfluenzaA__ACZ05557

SEQ ID NO: 3616 - protein, 565 aa, Artificial Sequence
  hemagglutinin__InfluenzaA__ACZ05579
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3617 - protein, 565 aa, Artificial Sequence
  hemagglutinin__InfluenzaA__ACZ05590
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISDQKTLYHTEDAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3618 - protein, 566 aa, Artificial Sequence; identical to SEQ ID NO: 3613
  hemagglutinin__InfluenzaA__ACZ05950

SEQ ID NO: 3619 - protein, 566 aa, Artificial Sequence; identical to SEQ ID NO: 3588
  hemagglutinin__InfluenzaA__ACZ05961

SEQ ID NO: 3620 - protein, 566 aa, Artificial Sequence
  hemagglutinin__InfluenzaA__ACZ05972
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCSLLCVALLGFIMWACQKGNIRCNICI

SEQ ID NO: 3621 - protein, 566 aa, Artificial Sequence
  hemagglutinin__InfluenzaA__ACZ05983
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRNTYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3622 - protein, 566 aa, Artificial Sequence
  hemagglutinin__InfluenzaA__ACZ05994
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTVPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3623 - protein, 566 aa, Artificial Sequence; identical to SEQ ID NO: 3588
  hemagglutinin__InfluenzaA__ACZ06005

SEQ ID NO: 3624 - protein, 566 aa, Artificial Sequence; identical to SEQ ID NO: 3588
  hemagglutinin__InfluenzaA__ACZ06016

SEQ ID NO: 3625 - protein, 565 aa, Artificial Sequence
  hemagglutinin__InfluenzaA__ACZ16013
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTEKAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3626 - protein, 565 aa, Artificial Sequence
  hemagglutinin__InfluenzaA__ACZ16023
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3627 - protein, 565 aa, Artificial Sequence
  hemagglutinin__InfluenzaA__ACZ16033
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGASASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNIHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNKEKIDGVKLESMGVYQILAIYSTVASSLVLLVSLGAISFWMCSNGSLQCRICI

SEQ ID NO: 3628 - protein, 566 aa, Artificial Sequence; identical to SEQ ID NO: 2656
  hemagglutinin__InfluenzaA__ACZ16040

SEQ ID NO: 3629 - protein, 566 aa, Artificial Sequence; identical to SEQ ID NO: 2656
  hemagglutinin__InfluenzaA__ACZ16050

SEQ ID NO: 3630 - protein, 566 aa, Artificial Sequence; identical to SEQ ID NO: 2656
  hemagglutinin__InfluenzaA__ACZ16060

SEQ ID NO: 3631 - protein, 566 aa, Artificial Sequence
  hemagglutinin__InfluenzaA__ACZ16070
MKAILVVLLYTFATANADTLCIGYHANNSTDTVDTVLEKNVTVTHSVSLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3632 - protein, 566 aa, Artificial Sequence
  hemagglutinin__InfluenzaA__ACZ16080
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNDGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3633 - protein, 566 aa, Artificial Sequence
  hemagglutinin__InfluenzaA__ACZ16090
MKAILLVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSMSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3634 - protein, 566 aa, Artificial Sequence; identical to SEQ ID NO: 2656
  hemagglutinin__InfluenzaA__ACZ16100

SEQ ID NO: 3635 - protein, 566 aa, Artificial Sequence; identical to SEQ ID NO: 2656
  hemagglutinin__InfluenzaA__ACZ16110

SEQ ID NO: 3636 - protein, 566 aa, Artificial Sequence; identical to SEQ ID NO: 2656
  hemagglutinin__InfluenzaA__ACZ16120

SEQ ID NO: 3637 - protein, 566 aa, Artificial Sequence; identical to SEQ ID NO: 3404
  hemagglutinin__InfluenzaA__ACZ16130

SEQ ID NO: 3638 - protein, 566 aa, Artificial Sequence; identical to SEQ ID NO: 2656
  hemagglutinin__InfluenzaA__ACZ16140

SEQ ID NO: 3639 - protein, 566 aa, Artificial Sequence; identical to SEQ ID NO: 2656
  hemagglutinin__InfluenzaA__ACZ16150

SEQ ID NO: 3640 - protein, 566 aa, Artificial Sequence; identical to SEQ ID NO: 2656
  hemagglutinin__InfluenzaA__ACZ16160

SEQ ID NO: 3641 - protein, 566 aa, Artificial Sequence; identical to SEQ ID NO: 2849
  hemagglutinin__InfluenzaA__ACZ16170

SEQ ID NO: 3642 - protein, 566 aa, Artificial Sequence
  hemagglutinin__InfluenzaA__ACZ16180
MKAILVVLLYTFATANADTLCIGYHANNSTDTVDTVLEKNVTVTHSVNLLEDKHNGKLCKLRGVAPLHLGKCNIAGWILGNPECESLYTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3643 - protein, 566 aa, Artificial Sequence; identical to SEQ ID NO: 2656
  hemagglutinin__InfluenzaA__ACZ16190

SEQ ID NO: 3644 - protein, 566 aa, Artificial Sequence
  hemagglutinin__InfluenzaA__ACZ16200
MKAILVVLLYTFATANPDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3645 - protein, 566 aa, Artificial Sequence; identical to SEQ ID NO: 2656
  hemagglutinin__InfluenzaA__ACZ16210

SEQ ID NO: 3646 - protein, 566 aa, Artificial Sequence; identical to SEQ ID NO: 2656
  hemagglutinin__InfluenzaA__ACZ16220

SEQ ID NO: 3647 - protein, 566 aa, Artificial Sequence; identical to SEQ ID NO: 3404
  hemagglutinin__InfluenzaA__ACZ16230

SEQ ID NO: 3648 - protein, 566 aa, Artificial Sequence
  hemagglutinin__InfluenzaA__ACZ16240
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNALDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3649 - protein, 566 aa, Artificial Sequence; identical to SEQ ID NO: 2656
  hemagglutinin__InfluenzaA__ACZ16260

SEQ ID NO: 3650 - protein, 566 aa, Artificial Sequence
  hemagglutinin__InfluenzaA__ACZ16270
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQNLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLILVVSLGAISFWMCSNGSLQCRICI

SEQ ID NO: 3651 - protein, 566 aa, Artificial Sequence; identical to SEQ ID NO: 3331
  hemagglutinin__InfluenzaA__ACZ16280

SEQ ID NO: 3652 - protein, 566 aa, Artificial Sequence; identical to SEQ ID NO: 2656
  hemagglutinin__InfluenzaA__ACZ16290

SEQ ID NO: 3653 - protein, 566 aa, Artificial Sequence
  hemagglutinin__InfluenzaA__ACZ16300
MKAILVVLLYTFATANADTLCIGYHANNSTDTVDTVLEKNVIVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3654 - protein, 566 aa, Artificial Sequence; identical to SEQ ID NO: 3399
  hemagglutinin__InfluenzaA__ACZ16310

SEQ ID NO: 3655 - protein, 566 aa, Artificial Sequence
  hemagglutinin__InfluenzaA__ACZ16320
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTRLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3656 - protein, 566 aa, Artificial Sequence; identical to SEQ ID NO: 3399
  hemagglutinin__InfluenzaA__ACZ16330

SEQ ID NO: 3657 - protein, 566 aa, Artificial Sequence; identical to SEQ ID NO: 2849
  hemagglutinin__InfluenzaA__ACZ16340

SEQ ID NO: 3658 - protein, 566 aa, Artificial Sequence; identical to SEQ ID NO: 2656
  hemagglutinin__InfluenzaA__ACZ16350

SEQ ID NO: 3659 - protein, 566 aa, Artificial Sequence; identical to SEQ ID NO: 2656
  hemagglutinin__InfluenzaA__ACZ16360

SEQ ID NO: 3660 - protein, 566 aa, Artificial Sequence; identical to SEQ ID NO: 2849
  hemagglutinin__InfluenzaA__ACZ16370

SEQ ID NO: 3661 - protein, 566 aa, Artificial Sequence; identical to SEQ ID NO: 2656
  hemagglutinin__InfluenzaA__ACZ16380

SEQ ID NO: 3662 - protein, 566 aa, Artificial Sequence; identical to SEQ ID NO: 2656
  hemagglutinin__InfluenzaA__ACZ16390

SEQ ID NO: 3663 - protein, 566 aa, Artificial Sequence; identical to SEQ ID NO: 2656
  hemagglutinin__InfluenzaA__ACZ16400

SEQ ID NO: 3664 - protein, 566 aa, Artificial Sequence; identical to SEQ ID NO: 2656
  hemagglutinin__InfluenzaA__ACZ16410

SEQ ID NO: 3665 - protein, 566 aa, Artificial Sequence; identical to SEQ ID NO: 3293
  hemagglutinin__InfluenzaA__ACZ16420

SEQ ID NO: 3666 - protein, 566 aa, Artificial Sequence; identical to SEQ ID NO: 2656
  hemagglutinin__InfluenzaA__ACZ16430

SEQ ID NO: 3667 - protein, 566 aa, Artificial Sequence; identical to SEQ ID NO: 2656
  hemagglutinin__InfluenzaA__ACZ16440

SEQ ID NO: 3668 - protein, 566 aa, Artificial Sequence
  hemagglutinin__InfluenzaA__ACZ16450
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3669 - protein, 566 aa, Artificial Sequence; identical to SEQ ID NO: 2849
  hemagglutinin__InfluenzaA__ACZ16460

SEQ ID NO: 3670 - protein, 566 aa, Artificial Sequence; identical to SEQ ID NO: 2656
  hemagglutinin__InfluenzaA__ACZ16470

SEQ ID NO: 3671 - protein, 566 aa, Artificial Sequence; identical to SEQ ID NO: 2656
  hemagglutinin__InfluenzaA__ACZ16480

SEQ ID NO: 3672 - protein, 566 aa, Artificial Sequence; identical to SEQ ID NO: 3404
  hemagglutinin__InfluenzaA__ACZ16490

SEQ ID NO: 3673 - protein, 566 aa, Artificial Sequence; identical to SEQ ID NO: 2656
  hemagglutinin__InfluenzaA__ACZ16500

SEQ ID NO: 3674 - protein, 566 aa, Artificial Sequence; identical to SEQ ID NO: 2849
  hemagglutinin__InfluenzaA__ACZ16510

SEQ ID NO: 3675 - protein, 566 aa, Artificial Sequence; identical to SEQ ID NO: 2656
  hemagglutinin__InfluenzaA__ACZ16530

SEQ ID NO: 3676 - protein, 566 aa, Artificial Sequence
  hemagglutinin__InfluenzaA__ACZ16540
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLLGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3677 - protein, 566 aa, Artificial Sequence; identical to SEQ ID NO: 3399
  hemagglutinin__InfluenzaA__ACZ16550

SEQ ID NO: 3678 - protein, 566 aa, Artificial Sequence; identical to SEQ ID NO: 2656
  hemagglutinin__InfluenzaA__ACZ16583

SEQ ID NO: 3679 - protein, 566 aa, Artificial Sequence; identical to SEQ ID NO: 3399
  hemagglutinin__InfluenzaA__ACZ16593

SEQ ID NO: 3680 - protein, 566 aa, Artificial Sequence; identical to SEQ ID NO: 2656
  hemagglutinin__InfluenzaA__ACZ16603

SEQ ID NO: 3681 - protein, 566 aa, Artificial Sequence; identical to SEQ ID NO: 3399
  hemagglutinin__InfluenzaA__ACZ16630

SEQ ID NO: 3682 - protein, 566 aa, Artificial Sequence; identical to SEQ ID NO: 2656
  hemagglutinin__InfluenzaA__ACZ16640

SEQ ID NO: 3683 - protein, 566 aa, Artificial Sequence; identical to SEQ ID NO: 2656
  hemagglutinin__InfluenzaA__ACZ16650

SEQ ID NO: 3684 - protein, 566 aa, Artificial Sequence; identical to SEQ ID NO: 2656
  hemagglutinin__InfluenzaA__ACZ16660

SEQ ID NO: 3685 - protein, 566 aa, Artificial Sequence; identical to SEQ ID NO: 2656
  hemagglutinin__InfluenzaA__ACZ16670

SEQ ID NO: 3686 - protein, 566 aa, Artificial Sequence; identical to SEQ ID NO: 2656
  hemagglutinin__InfluenzaA__ACZ16680

SEQ ID NO: 3687 - protein, 566 aa, Artificial Sequence; identical to SEQ ID NO: 2656
  hemagglutinin__InfluenzaA__ACZ16690

SEQ ID NO: 3688 - protein, 566 aa, Artificial Sequence; identical to SEQ ID NO: 2656
  hemagglutinin__InfluenzaA__ACZ16700

SEQ ID NO: 3689 - protein, 566 aa, Artificial Sequence; identical to SEQ ID NO: 2656
  hemagglutinin__InfluenzaA__ACZ16710

SEQ ID NO: 3690 - protein, 566 aa, Artificial Sequence; identical to SEQ ID NO: 2656
  hemagglutinin__InfluenzaA__ACZ16720

SEQ ID NO: 3691 - protein, 566 aa, Artificial Sequence; identical to SEQ ID NO: 3399
  hemagglutinin__InfluenzaA__ACZ16730

SEQ ID NO: 3692 - protein, 566 aa, Artificial Sequence; identical to SEQ ID NO: 3399
  hemagglutinin__InfluenzaA__ACZ16740

SEQ ID NO: 3693 - protein, 566 aa, Artificial Sequence; identical to SEQ ID NO: 2656
  hemagglutinin__InfluenzaA__ACZ16750

SEQ ID NO: 3694 - protein, 566 aa, Artificial Sequence; identical to SEQ ID NO: 2656
  hemagglutinin__InfluenzaA__ACZ16760

SEQ ID NO: 3695 - protein, 566 aa, Artificial Sequence; identical to SEQ ID NO: 2849
  hemagglutinin__InfluenzaA__ACZ16770

SEQ ID NO: 3696 - protein, 566 aa, Artificial Sequence; identical to SEQ ID NO: 2656
  hemagglutinin__InfluenzaA__ACZ16780

SEQ ID NO: 3697 - protein, 566 aa, Artificial Sequence; identical to SEQ ID NO: 2656
  hemagglutinin__InfluenzaA__ACZ16790

SEQ ID NO: 3698 - protein, 566 aa, Artificial Sequence; identical to SEQ ID NO: 2656
  hemagglutinin__InfluenzaA__ACZ16800

SEQ ID NO: 3699 - protein, 566 aa, Artificial Sequence; identical to SEQ ID NO: 2656
  hemagglutinin__InfluenzaA__ACZ16810

SEQ ID NO: 3700 - protein, 566 aa, Artificial Sequence; identical to SEQ ID NO: 3331
  hemagglutinin__InfluenzaA__ACZ16820

SEQ ID NO: 3701 - protein, 566 aa, Artificial Sequence; identical to SEQ ID NO: 2656
  hemagglutinin__InfluenzaA__ACZ16830

SEQ ID NO: 3702 - protein, 566 aa, Artificial Sequence
  hemagglutinin__InfluenzaA__ACZ16840
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRTKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3703 - protein, 566 aa, Artificial Sequence; identical to SEQ ID NO: 2656
  hemagglutinin__InfluenzaA__ACZ16850

SEQ ID NO: 3704 - protein, 566 aa, Artificial Sequence
  hemagglutinin__InfluenzaA__ACZ16860
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3705 - protein, 566 aa, Artificial Sequence; identical to SEQ ID NO: 3399
  hemagglutinin__InfluenzaA__ACZ16870

SEQ ID NO: 3706 - protein, 566 aa, Artificial Sequence
  hemagglutinin__InfluenzaA__ACZ16880
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNDGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCNNTCMESVKNGTYDYPKYSEEAKLNREEIDGVKLESTRIYQILAIYSTVASSLVLVVSLGAISFWMCSNGSLQCRICI

SEQ ID NO: 3707 - protein, 566 aa, Artificial Sequence; identical to SEQ ID NO: 3404
  hemagglutinin__InfluenzaA__ACZ16890

SEQ ID NO: 3708 - protein, 566 aa, Artificial Sequence; identical to SEQ ID NO: 2656
  hemagglutinin__InfluenzaA__ACZ16900

SEQ ID NO: 3709 - protein, 566 aa, Artificial Sequence; identical to SEQ ID NO: 2656
  hemagglutinin__InfluenzaA__ACZ16910

SEQ ID NO: 3710 - protein, 566 aa, Artificial Sequence; identical to SEQ ID NO: 2656
  hemagglutinin__InfluenzaA__ACZ16920

SEQ ID NO: 3711 - protein, 566 aa, Artificial Sequence; identical to SEQ ID NO: 2669
  hemagglutinin__InfluenzaA__ACZ16930

SEQ ID NO: 3712 - protein, 566 aa, Artificial Sequence; identical to SEQ ID NO: 2669
  hemagglutinin__InfluenzaA__ACZ16940

SEQ ID NO: 3713 - protein, 566 aa, Artificial Sequence; identical to SEQ ID NO: 2656
  hemagglutinin__InfluenzaA__ACZ16950

SEQ ID NO: 3714 - protein, 566 aa, Artificial Sequence; identical to SEQ ID NO: 2911
  hemagglutinin__InfluenzaA__ACZ16960

SEQ ID NO: 3715 - protein, 566 aa, Artificial Sequence
  hemagglutinin__InfluenzaA__ACZ16970
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKEGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3716 - protein, 566 aa, Artificial Sequence; identical to SEQ ID NO: 2669
  hemagglutinin__InfluenzaA__ACZ16980

SEQ ID NO: 3717 - protein, 566 aa, Artificial Sequence; identical to SEQ ID NO: 2669
  hemagglutinin__InfluenzaA__ACZ17000

SEQ ID NO: 3718 - protein, 566 aa, Artificial Sequence
  hemagglutinin__InfluenzaA__ACZ17010
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3719 - protein, 566 aa, Artificial Sequence; identical to SEQ ID NO: 2669
  hemagglutinin__InfluenzaA__ACZ17020

SEQ ID NO: 3720 - protein, 566 aa, Artificial Sequence
  hemagglutinin__InfluenzaA__ACZ17030
MKATLVVLLYTFATANADTLCIGYHANNSTDTVDTVLEKNVTVTHSVNLLEDKHNGKLCKLRGVAPLHLGKCNIAGWILGNPECESLSTASSWSYIVEASSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3721 - protein, 566 aa, Artificial Sequence
  hemagglutinin__InfluenzaA__ACZ17040
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 3722 - protein, 566 aa, Artificial Sequence; identical to SEQ ID NO: 2669
  hemagglutinin__InfluenzaA__ACZ17050

SEQ ID NO: 3723 - protein, 566 aa, Artificial Sequence; identical to SEQ ID NO: 2669
  hemagglutinin__InfluenzaA__ACZ17060

SEQ ID NO: 3724 - protein, 566 aa, Artificial Sequence; identical to SEQ ID NO: 2669
  hemagglutinin__InfluenzaA__ACZ17070

SEQ ID NO: 3725 - protein, 566 aa, Artificial Sequence; identical to SEQ ID NO: 2849
  hemagglutinin__InfluenzaA__ACZ17080

SEQ ID NO: 3726 - protein, 566 aa, Artificial Sequence
  hemagglutinin__InfluenzaA__ACZ17090
MKAILVVLLYTFATANADTLCIGYHANNSTDTVDTVLEKNVTVTHSVNLLGDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3727 - protein, 566 aa, Artificial Sequence; identical to SEQ ID NO: 2656
  hemagglutinin__InfluenzaA__ACZ17100

SEQ ID NO: 3728 - protein, 566 aa, Artificial Sequence
  hemagglutinin__InfluenzaA__ACZ17110
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPELSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3729 - protein, 566 aa, Artificial Sequence
  hemagglutinin__InfluenzaA__ACZ17120
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3730 - protein, 566 aa, Artificial Sequence
  hemagglutinin__InfluenzaA__ACZ17130
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNAQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3731 - protein, 566 aa, Artificial Sequence; identical to SEQ ID NO: 3467
  hemagglutinin__InfluenzaA__ACZ17140

SEQ ID NO: 3732 - protein, 566 aa, Artificial Sequence; identical to SEQ ID NO: 3298
  hemagglutinin__InfluenzaA__ACZ17150

SEQ ID NO: 3733 - protein, 566 aa, Artificial Sequence; identical to SEQ ID NO: 3298
  hemagglutinin__InfluenzaA__ACZ17160

SEQ ID NO: 3734 - protein, 566 aa, Artificial Sequence; identical to SEQ ID NO: 3298
  hemagglutinin__InfluenzaA__ACZ17170

SEQ ID NO: 3735 - protein, 566 aa, Artificial Sequence
  hemagglutinin__InfluenzaA__ACZ17190
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCSTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3736 - protein, 566 aa, Artificial Sequence; identical to SEQ ID NO: 3735
  hemagglutinin__InfluenzaA__ACZ17200

SEQ ID NO: 3737 - protein, 566 aa, Artificial Sequence; identical to SEQ ID NO: 2669
  hemagglutinin__InfluenzaA__ACZ17220

SEQ ID NO: 3738 - protein, 566 aa, Artificial Sequence
  hemagglutinin__InfluenzaA__ACZ17230
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELKEQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3739 - protein, 566 aa, Artificial Sequence; identical to SEQ ID NO: 2669
  hemagglutinin__InfluenzaA__ACZ17240

SEQ ID NO: 3740 - protein, 566 aa, Artificial Sequence; identical to SEQ ID NO: 2669
  hemagglutinin__InfluenzaA__ACZ17250

SEQ ID NO: 3741 - protein, 566 aa, Artificial Sequence; identical to SEQ ID NO: 2669
  hemagglutinin__InfluenzaA__ACZ17260

SEQ ID NO: 3742 - protein, 566 aa, Artificial Sequence
  hemagglutinin__InfluenzaA__ACZ17270
MKAILVVLLYTFATANADTLCIGYHANNSTDTVDTVLEKNVTVTHSVNLLEDKHNGKLCKLRGVAPLHLGRCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 3743 - protein, 566 aa, Artificial Sequence; identical to SEQ ID NO: 2849
  hemagglutinin__InfluenzaA__ACZ17290

SEQ ID NO: 3744 - protein, 566 aa, Artificial Sequence; identical to SEQ ID NO: 2849
  hemagglutinin__InfluenzaA__ACZ17300

SEQ ID NO: 3745 - protein, 566 aa, Artificial Sequence; identical to SEQ ID NO: 2849
  hemagglutinin__InfluenzaA__ACZ17310

SEQ ID NO: 3746 - protein, 566 aa, Artificial Sequence; identical to SEQ ID NO: 2669
  hemagglutinin__InfluenzaA__ACZ17398

SEQ ID NO: 3747 - protein, 566 aa, Artificial Sequence; identical to SEQ ID NO: 2669
  hemagglutinin__InfluenzaA__ACZ17408

SEQ ID NO: 3748 - protein, 566 aa, Artificial Sequence; identical to SEQ ID NO: 2669
  hemagglutinin__InfluenzaA__ACZ17418

SEQ ID NO: 3749 - protein, 566 aa, Artificial Sequence
  hemagglutinin__InfluenzaA__ACZ17438
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3750 - protein, 566 aa, Artificial Sequence; identical to SEQ ID NO: 2656
  hemagglutinin__InfluenzaA__ACZ17448

SEQ ID NO: 3751 - protein, 566 aa, Artificial Sequence; identical to SEQ ID NO: 2669
  hemagglutinin__InfluenzaA__ACZ17458

SEQ ID NO: 3752 - protein, 566 aa, Artificial Sequence; identical to SEQ ID NO: 2656
  hemagglutinin__InfluenzaA__ACZ17478

SEQ ID NO: 3753 - protein, 566 aa, Artificial Sequence; identical to SEQ ID NO: 2669
  hemagglutinin__InfluenzaA__ACZ17488

SEQ ID NO: 3754 - protein, 566 aa, Artificial Sequence
  hemagglutinin__InfluenzaA__ACZ18240
MKAILVVLLYTFATANADTLCIGYHANNSTDTVDTVLEKNVTVTHSVNLLEDKHNGKLCKLRGVAPLHLGKCNIAGWILGNPECESLSTTSSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3755 - protein, 566 aa, Artificial Sequence; identical to SEQ ID NO: 2669
  hemagglutinin__InfluenzaA__ACZ18241

SEQ ID NO: 3756 - protein, 566 aa, Artificial Sequence
  hemagglutinin__InfluenzaA__ACZ27800
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKEFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3757 - protein, 566 aa, Artificial Sequence; identical to SEQ ID NO: 2669
  hemagglutinin__InfluenzaA__ACZ27810

SEQ ID NO: 3758 - protein, 566 aa, Artificial Sequence; identical to SEQ ID NO: 2669
  hemagglutinin__InfluenzaA__ACZ27820

SEQ ID NO: 3759 - protein, 566 aa, Artificial Sequence; identical to SEQ ID NO: 2669
  hemagglutinin__InfluenzaA__ACZ27830

SEQ ID NO: 3760 - protein, 566 aa, Artificial Sequence; identical to SEQ ID NO: 3022
  hemagglutinin__InfluenzaA__ACZ27840

SEQ ID NO: 3761 - protein, 566 aa, Artificial Sequence; identical to SEQ ID NO: 2656
  hemagglutinin__InfluenzaA__ACZ45006

SEQ ID NO: 3762 - protein, 566 aa, Artificial Sequence
  hemagglutinin__InfluenzaA__ACZ45007
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGDAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3763 - protein, 566 aa, Artificial Sequence; identical to SEQ ID NO: 3022
  hemagglutinin__InfluenzaA__ACZ45008

SEQ ID NO: 3764 - protein, 566 aa, Artificial Sequence; identical to SEQ ID NO: 3022
  hemagglutinin__InfluenzaA__ACZ45009

SEQ ID NO: 3765 - protein, 566 aa, Artificial Sequence; identical to SEQ ID NO: 2911
  hemagglutinin__InfluenzaA__ACZ45010

SEQ ID NO: 3766 - protein, 566 aa, Artificial Sequence; identical to SEQ ID NO: 2669
  hemagglutinin__InfluenzaA__ACZ45012

SEQ ID NO: 3767 - protein, 566 aa, Artificial Sequence
  hemagglutinin__InfluenzaA__ACZ45013
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSSKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3768 - protein, 566 aa, Artificial Sequence; identical to SEQ ID NO: 2669
  hemagglutinin__InfluenzaA__ACZ45014

SEQ ID NO: 3769 - protein, 566 aa, Artificial Sequence; identical to SEQ ID NO: 2669
  hemagglutinin__InfluenzaA__ACZ45016

SEQ ID NO: 3770 - protein, 566 aa, Artificial Sequence
  hemagglutinin__InfluenzaA__ACZ45028
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3771 - protein, 566 aa, Artificial Sequence
  hemagglutinin__InfluenzaA__ACZ45029
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3772 - protein, 566 aa, Artificial Sequence
  hemagglutinin__InfluenzaA__ACZ45030
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSTYSKKFKPEIAIRPKVRDQEGRMNYYWTLVEPGDKITFEATGNLVVPRYAFTMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3773 - protein, 566 aa, Artificial Sequence
  hemagglutinin__InfluenzaA__ACZ45031
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFTMERNVGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3774 - protein, 566 aa, Artificial Sequence
  hemagglutinin__InfluenzaA__ACZ45034
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPPIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3775 - protein, 566 aa, Artificial Sequence; identical to SEQ ID NO: 2669
  hemagglutinin__InfluenzaA__ACZ45036

SEQ ID NO: 3776 - protein, 566 aa, Artificial Sequence; identical to SEQ ID NO: 2669
  hemagglutinin__InfluenzaA__ACZ45037

SEQ ID NO: 3777 - protein, 566 aa, Artificial Sequence; identical to SEQ ID NO: 3770
  hemagglutinin__InfluenzaA__ACZ45038

SEQ ID NO: 3778 - protein, 566 aa, Artificial Sequence; identical to SEQ ID NO: 3022
  hemagglutinin__InfluenzaA__ACZ45039

SEQ ID NO: 3779 - protein, 566 aa, Artificial Sequence; identical to SEQ ID NO: 2669
  hemagglutinin__InfluenzaA__ACZ45040

SEQ ID NO: 3780 - protein, 566 aa, Artificial Sequence; identical to SEQ ID NO: 2669
  hemagglutinin__InfluenzaA__ACZ52567

SEQ ID NO: 3781 - protein, 566 aa, Artificial Sequence; identical to SEQ ID NO: 2669
  hemagglutinin__InfluenzaA__ACZ52568

SEQ ID NO: 3782 - protein, 566 aa, Artificial Sequence; identical to SEQ ID NO: 3238
  hemagglutinin__InfluenzaA__ACZ52569

SEQ ID NO: 3783 - protein, 566 aa, Artificial Sequence
  hemagglutinin__InfluenzaA__ACZ53956
MKTIIALSYIFCLALAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSTLNWLHQLQNRYPALNVTMPNNDKFDKLYIWGVHHPSTDSDQISVYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQRGNIRCNICI

SEQ ID NO: 3784 - protein, 566 aa, Artificial Sequence
  hemagglutinin__InfluenzaA__ACZ53967
MKTIIALSYIFCLALAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSTLNWLHQLQNRYPALNVTMPNNDKFDKLYIWGVHHPSTDSDQTSLYAQASGRVTVSTKRSQQTVIPNIGSRPWVRGVSSRISIYWTIVKPGDVLVINSNGNLIAPRGYFKMRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNKLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGSIMWACQRGNIRCNICI

SEQ ID NO: 3785 - protein, 566 aa, Artificial Sequence
  hemagglutinin__InfluenzaA__ACZ53978
MKTIIALSYIFCLALAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLKSLIASSGTLEFNNESFNWIGVSQNGTSSACKRISITVSFNKLNWLHQLKYRYPALNVTMPNNDKFDKLYIWGVHHPSTDSDQTSLYAQASGRVTVSTKRSQQTVIPNIGSRPWVRGVSSRISIYWTIVKPGDVLVINSNGNLIAPRGYFKMRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQITGKLNKLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQRGNIRCNICI

SEQ ID NO: 3786 - protein, 566 aa, Artificial Sequence
  hemagglutinin__InfluenzaA__ACZ56080
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3787 - protein, 566 aa, Artificial Sequence
  hemagglutinin__InfluenzaA__ACZ61118
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHQSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3788 - protein, 566 aa, Artificial Sequence
  hemagglutinin__InfluenzaA__ACZ61119
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLILLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3789 - protein, 566 aa, Artificial Sequence; identical to SEQ ID NO: 2669
  hemagglutinin__InfluenzaA__ACZ61122

SEQ ID NO: 3790 - protein, 566 aa, Artificial Sequence; identical to SEQ ID NO: 2669
  hemagglutinin__InfluenzaA__ACZ61123

SEQ ID NO: 3791 - protein, 566 aa, Artificial Sequence; identical to SEQ ID NO: 3467
  hemagglutinin__InfluenzaA__ACZ74627

SEQ ID NO: 3792 - protein, 565 aa, Artificial Sequence
  hemagglutinin__InfluenzaA__ACZ81554
MKVKLLVLLCTFTATYADTICIGYHANNSTDTVDTVLEKNVTVTHSVNLLENNHNGKLCLLKGIAPLQLGNCTVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKIRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3793 - protein, 565 aa, Artificial Sequence
  hemagglutinin__InfluenzaA__ACZ81555
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIGDQKTLYHTENAYVSVVSSHYSRKFTPEIAKRPKVRDQEGRINYYWALLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3794 - protein, 565 aa, Artificial Sequence
  hemagglutinin__InfluenzaA__ACZ81556
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGASASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNKEKIDGVKLESMGVYQILAIYSTVASSLVLLVSLGAISFWMCSNGSLQCRICI

SEQ ID NO: 3795 - protein, 566 aa, Artificial Sequence
  hemagglutinin__InfluenzaA__ACZ81557
MKTIIALSYILCLVFAQKLPGNDNSTATLCLGHHAVPNGTIVKTITNDQIEVTNATELVQSSSTGEICGSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYQALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3796 - protein, 566 aa, Artificial Sequence
  hemagglutinin__InfluenzaA__ACZ81558
MKTIIALSYILCLVFAQKLPGNDNSTATLCLGHHAVPNGTIVKTITNDQIEVTNATELVQSSSTGEICDSPHQILDGKNCTLIDALLGDPHCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIEKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3797 - protein, 566 aa, Artificial Sequence
  hemagglutinin__InfluenzaA__ACZ81559
MKTIIALSYILCLVFAQKLPGNDNSTATLCLGHHAVPNGTIVKTITNDQIEVTNATELVQSSSTGEICDSPHQILDGKNCTLIDALLGDPHCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3798 - protein, 566 aa, Artificial Sequence; identical to SEQ ID NO: 2669
  hemagglutinin__InfluenzaA__ACZ81632

SEQ ID NO: 3799 - protein, 566 aa, Artificial Sequence; identical to SEQ ID NO: 2669
  hemagglutinin__InfluenzaA__ACZ81642

SEQ ID NO: 3800 - protein, 566 aa, Artificial Sequence
  hemagglutinin__InfluenzaA__ACZ81652
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAEAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3801 - protein, 566 aa, Artificial Sequence
  hemagglutinin__InfluenzaA__ACZ92130
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCIESVKNGTYDYPKYSEEAKLNREEIDGVKLESTRIYQILAIYSTVASSLVLVVSLGAISFWMCSNGSLQCRICI

SEQ ID NO: 3802 - protein, 566 aa, Artificial Sequence; identical to SEQ ID NO: 2911
  hemagglutinin__InfluenzaA__ACZ92131

SEQ ID NO: 3803 - protein, 566 aa, Artificial Sequence; identical to SEQ ID NO: 2911
  hemagglutinin__InfluenzaA__ACZ92132

SEQ ID NO: 3804 - protein, 566 aa, Artificial Sequence; identical to SEQ ID NO: 2911
  hemagglutinin__InfluenzaA__ACZ92133

SEQ ID NO: 3805 - protein, 566 aa, Artificial Sequence; identical to SEQ ID NO: 2669
  hemagglutinin__InfluenzaA__ACZ92134

SEQ ID NO: 3806 - protein, 566 aa, Artificial Sequence; identical to SEQ ID NO: 2669
  hemagglutinin__InfluenzaA__ACZ95465

SEQ ID NO: 3807 - protein, 566 aa, Artificial Sequence; identical to SEQ ID NO: 2656
  hemagglutinin__InfluenzaA__ACZ95837

SEQ ID NO: 3808 - protein, 566 aa, Artificial Sequence; identical to SEQ ID NO: 2669
  hemagglutinin__InfluenzaA__ACZ95847

SEQ ID NO: 3809 - protein, 566 aa, Artificial Sequence
  hemagglutinin__InfluenzaA__ACZ95857
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTSKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3810 - protein, 566 aa, Artificial Sequence; identical to SEQ ID NO: 2669
  hemagglutinin__InfluenzaA__ACZ95867

SEQ ID NO: 3811 - protein, 566 aa, Artificial Sequence
  hemagglutinin__InfluenzaA__ACZ95887
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRNQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3812 - protein, 566 aa, Artificial Sequence; identical to SEQ ID NO: 2669
  hemagglutinin__InfluenzaA__ACZ95897

SEQ ID NO: 3813 - protein, 566 aa, Artificial Sequence
  hemagglutinin__InfluenzaA__ACZ95907
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVYDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3814 - protein, 566 aa, Artificial Sequence; identical to SEQ ID NO: 2669
  hemagglutinin__InfluenzaA__ACZ95927

SEQ ID NO: 3815 - protein, 566 aa, Artificial Sequence
  hemagglutinin__InfluenzaA__ACZ95937
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTNADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3816 - protein, 566 aa, Artificial Sequence; identical to SEQ ID NO: 2911
  hemagglutinin__InfluenzaA__ACZ95947

SEQ ID NO: 3817 - protein, 566 aa, Artificial Sequence; identical to SEQ ID NO: 2669
  hemagglutinin__InfluenzaA__ACZ95957

SEQ ID NO: 3818 - protein, 566 aa, Artificial Sequence; identical to SEQ ID NO: 2911
  hemagglutinin__InfluenzaA__ACZ95967

SEQ ID NO: 3819 - protein, 566 aa, Artificial Sequence; identical to SEQ ID NO: 3815
  hemagglutinin__InfluenzaA__ACZ95977

SEQ ID NO: 3820 - protein, 566 aa, Artificial Sequence
  hemagglutinin__InfluenzaA__ACZ95987
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMIDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3821 - protein, 566 aa, Artificial Sequence; identical to SEQ ID NO: 2669
  hemagglutinin__InfluenzaA__ACZ95997

SEQ ID NO: 3822 - protein, 566 aa, Artificial Sequence; identical to SEQ ID NO: 2669
  hemagglutinin__InfluenzaA__ACZ96007

SEQ ID NO: 3823 - protein, 566 aa, Artificial Sequence; identical to SEQ ID NO: 2656
  hemagglutinin__InfluenzaA__ACZ96017

SEQ ID NO: 3824 - protein, 566 aa, Artificial Sequence; identical to SEQ ID NO: 2669
  hemagglutinin__InfluenzaA__ACZ96027

SEQ ID NO: 3825 - protein, 566 aa, Artificial Sequence; identical to SEQ ID NO: 3815
  hemagglutinin__InfluenzaA__ACZ96047

SEQ ID NO: 3826 - protein, 566 aa, Artificial Sequence
  hemagglutinin__InfluenzaA__ACZ96057
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACLHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3827 - protein, 566 aa, Artificial Sequence
  hemagglutinin__InfluenzaA__ACZ96069
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGNKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3828 - protein, 566 aa, Artificial Sequence; identical to SEQ ID NO: 3815
  hemagglutinin__InfluenzaA__ACZ96089

SEQ ID NO: 3829 - protein, 566 aa, Artificial Sequence
  hemagglutinin__InfluenzaA__ACZ96119
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3830 - protein, 566 aa, Artificial Sequence
  hemagglutinin__InfluenzaA__ACZ96129
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGEFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3831 - protein, 566 aa, Artificial Sequence; identical to SEQ ID NO: 2669
  hemagglutinin__InfluenzaA__ACZ96149

SEQ ID NO: 3832 - protein, 566 aa, Artificial Sequence; identical to SEQ ID NO: 2669
  hemagglutinin__InfluenzaA__ACZ96159

SEQ ID NO: 3833 - protein, 566 aa, Artificial Sequence
  hemagglutinin__InfluenzaA__ACZ96179
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3834 - protein, 566 aa, Artificial Sequence; identical to SEQ ID NO: 3826
  hemagglutinin__InfluenzaA__ACZ96189

SEQ ID NO: 3835 - protein, 566 aa, Artificial Sequence; identical to SEQ ID NO: 3833
  hemagglutinin__InfluenzaA__ACZ96199

SEQ ID NO: 3836 - protein, 566 aa, Artificial Sequence; identical to SEQ ID NO: 2669
  hemagglutinin__InfluenzaA__ACZ96209

SEQ ID NO: 3837 - protein, 566 aa, Artificial Sequence
  hemagglutinin__InfluenzaA__ACZ96219
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKIKFEATGNLVVPRYAFAMERNAGSGIIISDTPVHDCNTTCQTSKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIAGVKLESTRIYQILAIYSTVASSLVLVVSLGAISFWMCSNGSLQCRICI

SEQ ID NO: 3838 - protein, 566 aa, Artificial Sequence; identical to SEQ ID NO: 2669
  hemagglutinin__InfluenzaA__ACZ96229

SEQ ID NO: 3839 - protein, 566 aa, Artificial Sequence; identical to SEQ ID NO: 3833
  hemagglutinin__InfluenzaA__ACZ96239

SEQ ID NO: 3840 - protein, 566 aa, Artificial Sequence; identical to SEQ ID NO: 2669
  hemagglutinin__InfluenzaA__ACZ96249

SEQ ID NO: 3841 - protein, 566 aa, Artificial Sequence
  hemagglutinin__InfluenzaA__ACZ96269
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3842 - protein, 566 aa, Artificial Sequence; identical to SEQ ID NO: 2669
  hemagglutinin__InfluenzaA__ACZ96299

SEQ ID NO: 3843 - protein, 566 aa, Artificial Sequence; identical to SEQ ID NO: 2669
  hemagglutinin__InfluenzaA__ACZ96309

SEQ ID NO: 3844 - protein, 566 aa, Artificial Sequence
  hemagglutinin__InfluenzaA__ACZ96319
MKAILVVLLYTFATANADTLCIGYHANNSTDTVDTVLEKNVTVTHSVNLLEDKHNGKLCKLRGVAPLHLGICNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3845 - protein, 566 aa, Artificial Sequence; identical to SEQ ID NO: 3844
  hemagglutinin__InfluenzaA__ACZ96329

SEQ ID NO: 3846 - protein, 566 aa, Artificial Sequence
  hemagglutinin__InfluenzaA__ACZ96339
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIKKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3847 - protein, 566 aa, Artificial Sequence; identical to SEQ ID NO: 2669
  hemagglutinin__InfluenzaA__ACZ96349

SEQ ID NO: 3848 - protein, 566 aa, Artificial Sequence; identical to SEQ ID NO: 3844
  hemagglutinin__InfluenzaA__ACZ96359

SEQ ID NO: 3849 - protein, 566 aa, Artificial Sequence; identical to SEQ ID NO: 2669
  hemagglutinin__InfluenzaA__ACZ96372

SEQ ID NO: 3850 - protein, 566 aa, Artificial Sequence; identical to SEQ ID NO: 3844
  hemagglutinin__InfluenzaA__ACZ96382

SEQ ID NO: 3851 - protein, 566 aa, Artificial Sequence; identical to SEQ ID NO: 2656
  hemagglutinin__InfluenzaA__ACZ96392

SEQ ID NO: 3852 - protein, 566 aa, Artificial Sequence; identical to SEQ ID NO: 2911
  hemagglutinin__InfluenzaA__ACZ96405

SEQ ID NO: 3853 - protein, 566 aa, Artificial Sequence; identical to SEQ ID NO: 2669
  hemagglutinin__InfluenzaA__ACZ96415

SEQ ID NO: 3854 - protein, 566 aa, Artificial Sequence; identical to SEQ ID NO: 2669
  hemagglutinin__InfluenzaA__ACZ96425

SEQ ID NO: 3855 - protein, 566 aa, Artificial Sequence
  hemagglutinin__InfluenzaA__ACZ96435
MKAILVVLLYTFATANADTLCIGYHANNSTDTVDTVLEKNVTVTHSVNLLEDKHNGKLCKLRGVAQLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLMVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3856 - protein, 566 aa, Artificial Sequence; identical to SEQ ID NO: 2669
  hemagglutinin__InfluenzaA__ACZ96445

SEQ ID NO: 3857 - protein, 566 aa, Artificial Sequence
  hemagglutinin__InfluenzaA__ACZ96476
MKAILVVLLYTFATAYADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3858 - protein, 566 aa, Artificial Sequence; identical to SEQ ID NO: 2669
  hemagglutinin__InfluenzaA__ACZ96496

SEQ ID NO: 3859 - protein, 566 aa, Artificial Sequence; identical to SEQ ID NO: 2669
  hemagglutinin__InfluenzaA__ACZ96506

SEQ ID NO: 3860 - protein, 566 aa, Artificial Sequence; identical to SEQ ID NO: 2669
  hemagglutinin__InfluenzaA__ACZ96526

SEQ ID NO: 3861 - protein, 566 aa, Artificial Sequence
  hemagglutinin__InfluenzaA__ACZ96536
MKAILVVLLYTFATANADTLCIGYHANNSTDTVDTVLEKNVTVTHSVNILEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKHVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3862 - protein, 566 aa, Artificial Sequence; identical to SEQ ID NO: 2669
  hemagglutinin__InfluenzaA__ACZ96549

SEQ ID NO: 3863 - protein, 566 aa, Artificial Sequence
  hemagglutinin__InfluenzaA__ACZ96559
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3864 - protein, 566 aa, Artificial Sequence
  hemagglutinin__InfluenzaA__ACZ96569
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3865 - protein, 566 aa, Artificial Sequence
  hemagglutinin__InfluenzaA__ACZ96579
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSSSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3866 - protein, 566 aa, Artificial Sequence; identical to SEQ ID NO: 2669
  hemagglutinin__InfluenzaA__ACZ96589

SEQ ID NO: 3867 - protein, 566 aa, Artificial Sequence
  hemagglutinin__InfluenzaA__ACZ96599
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNTGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3868 - protein, 566 aa, Artificial Sequence
  hemagglutinin__InfluenzaA__ACZ96609
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGTCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3869 - protein, 566 aa, Artificial Sequence; identical to SEQ ID NO: 2849
  hemagglutinin__InfluenzaA__ACZ96619

SEQ ID NO: 3870 - protein, 566 aa, Artificial Sequence; identical to SEQ ID NO: 2849
  hemagglutinin__InfluenzaA__ACZ96629

SEQ ID NO: 3871 - protein, 566 aa, Artificial Sequence; identical to SEQ ID NO: 2849
  hemagglutinin__InfluenzaA__ACZ96639

SEQ ID NO: 3872 - protein, 566 aa, Artificial Sequence; identical to SEQ ID NO: 2849
  hemagglutinin__InfluenzaA__ACZ96649

SEQ ID NO: 3873 - protein, 566 aa, Artificial Sequence; identical to SEQ ID NO: 2849
  hemagglutinin__InfluenzaA__ACZ96659

SEQ ID NO: 3874 - protein, 566 aa, Artificial Sequence; identical to SEQ ID NO: 2849
  hemagglutinin__InfluenzaA__ACZ96669

SEQ ID NO: 3875 - protein, 566 aa, Artificial Sequence; identical to SEQ ID NO: 2849
  hemagglutinin__InfluenzaA__ACZ96679

SEQ ID NO: 3876 - protein, 566 aa, Artificial Sequence; identical to SEQ ID NO: 2849
  hemagglutinin__InfluenzaA__ACZ96689

SEQ ID NO: 3877 - protein, 566 aa, Artificial Sequence; identical to SEQ ID NO: 2849
  hemagglutinin__InfluenzaA__ACZ96699

SEQ ID NO: 3878 - protein, 566 aa, Artificial Sequence; identical to SEQ ID NO: 2849
  hemagglutinin__InfluenzaA__ACZ96719

SEQ ID NO: 3879 - protein, 566 aa, Artificial Sequence; identical to SEQ ID NO: 2849
  hemagglutinin__InfluenzaA__ACZ96729

SEQ ID NO: 3880 - protein, 566 aa, Artificial Sequence; identical to SEQ ID NO: 2849
  hemagglutinin__InfluenzaA__ACZ96739

SEQ ID NO: 3881 - protein, 566 aa, Artificial Sequence
  hemagglutinin__InfluenzaA__ACZ96749
MKTILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3882 - protein, 566 aa, Artificial Sequence; identical to SEQ ID NO: 2656
  hemagglutinin__InfluenzaA__ACZ96759

SEQ ID NO: 3883 - protein, 566 aa, Artificial Sequence; identical to SEQ ID NO: 2656
  hemagglutinin__InfluenzaA__ACZ96769

SEQ ID NO: 3884 - protein, 566 aa, Artificial Sequence; identical to SEQ ID NO: 2656
  hemagglutinin__InfluenzaA__ACZ96779

SEQ ID NO: 3885 - protein, 566 aa, Artificial Sequence; identical to SEQ ID NO: 2656
  hemagglutinin__InfluenzaA__ACZ96789

SEQ ID NO: 3886 - protein, 566 aa, Artificial Sequence
  hemagglutinin__InfluenzaA__ACZ96809
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTNADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFAAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3887 - protein, 566 aa, Artificial Sequence; identical to SEQ ID NO: 2656
  hemagglutinin__InfluenzaA__ACZ96819

SEQ ID NO: 3888 - protein, 566 aa, Artificial Sequence; identical to SEQ ID NO: 2656
  hemagglutinin__InfluenzaA__ACZ96829

SEQ ID NO: 3889 - protein, 566 aa, Artificial Sequence; identical to SEQ ID NO: 2656
  hemagglutinin__InfluenzaA__ACZ96839

SEQ ID NO: 3890 - protein, 566 aa, Artificial Sequence; identical to SEQ ID NO: 3809
  hemagglutinin__InfluenzaA__ACZ96849

SEQ ID NO: 3891 - protein, 566 aa, Artificial Sequence; identical to SEQ ID NO: 2669
  hemagglutinin__InfluenzaA__ACZ96859

SEQ ID NO: 3892 - protein, 566 aa, Artificial Sequence; identical to SEQ ID NO: 2656
  hemagglutinin__InfluenzaA__ACZ96869

SEQ ID NO: 3893 - protein, 566 aa, Artificial Sequence; identical to SEQ ID NO: 2656
  hemagglutinin__InfluenzaA__ACZ96879

SEQ ID NO: 3894 - protein, 566 aa, Artificial Sequence
  hemagglutinin__InfluenzaA__ACZ96899
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHSSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3895 - protein, 566 aa, Artificial Sequence; identical to SEQ ID NO: 2656
  hemagglutinin__InfluenzaA__ACZ96909

SEQ ID NO: 3896 - protein, 566 aa, Artificial Sequence; identical to SEQ ID NO: 2656
  hemagglutinin__InfluenzaA__ACZ96919

SEQ ID NO: 3897 - protein, 566 aa, Artificial Sequence; identical to SEQ ID NO: 2656
  hemagglutinin__InfluenzaA__ACZ96929

SEQ ID NO: 3898 - protein, 566 aa, Artificial Sequence; identical to SEQ ID NO: 2656
  hemagglutinin__InfluenzaA__ACZ96939

SEQ ID NO: 3899 - protein, 566 aa, Artificial Sequence
  hemagglutinin__InfluenzaA__ACZ96949
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAEMLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3900 - protein, 566 aa, Artificial Sequence; identical to SEQ ID NO: 2656
  hemagglutinin__InfluenzaA__ACZ97021

SEQ ID NO: 3901 - protein, 566 aa, Artificial Sequence; identical to SEQ ID NO: 3023
  hemagglutinin__InfluenzaA__ACZ97343

SEQ ID NO: 3902 - protein, 566 aa, Artificial Sequence; identical to SEQ ID NO: 3023
  hemagglutinin__InfluenzaA__ACZ97353

SEQ ID NO: 3903 - protein, 566 aa, Artificial Sequence; identical to SEQ ID NO: 2656
  hemagglutinin__InfluenzaA__ACZ97363

SEQ ID NO: 3904 - protein, 566 aa, Artificial Sequence
  hemagglutinin__InfluenzaA__ACZ97383
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSTSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3905 - protein, 566 aa, Artificial Sequence; identical to SEQ ID NO: 2656
  hemagglutinin__InfluenzaA__ACZ97393

SEQ ID NO: 3906 - protein, 566 aa, Artificial Sequence
  hemagglutinin__InfluenzaA__ACZ98178
MKAILVVLLYTFATANADTLCIGYHANNSTDTVDTVLEKNVTVTHSVNLLEDKHYGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3907 - protein, 566 aa, Artificial Sequence; identical to SEQ ID NO: 2656
  hemagglutinin__InfluenzaA__ACZ98188

SEQ ID NO: 3908 - protein, 566 aa, Artificial Sequence; identical to SEQ ID NO: 2849
  hemagglutinin__InfluenzaA__ACZ98198

SEQ ID NO: 3909 - protein, 566 aa, Artificial Sequence; identical to SEQ ID NO: 2669
  hemagglutinin__InfluenzaA__ACZ98208

SEQ ID NO: 3910 - protein, 566 aa, Artificial Sequence; identical to SEQ ID NO: 2669
  hemagglutinin__InfluenzaA__ACZ98218

SEQ ID NO: 3911 - protein, 566 aa, Artificial Sequence; identical to SEQ ID NO: 2669
  hemagglutinin__InfluenzaA__ACZ98228

SEQ ID NO: 3912 - protein, 566 aa, Artificial Sequence; identical to SEQ ID NO: 2669
  hemagglutinin__InfluenzaA__ACZ98238

SEQ ID NO: 3913 - protein, 566 aa, Artificial Sequence; identical to SEQ ID NO: 3298
  hemagglutinin__InfluenzaA__ACZ98248

SEQ ID NO: 3914 - protein, 566 aa, Artificial Sequence; identical to SEQ ID NO: 2669
  hemagglutinin__InfluenzaA__ACZ98258

SEQ ID NO: 3915 - protein, 566 aa, Artificial Sequence; identical to SEQ ID NO: 2669
  hemagglutinin__InfluenzaA__ACZ98268

SEQ ID NO: 3916 - protein, 566 aa, Artificial Sequence; identical to SEQ ID NO: 3809
  hemagglutinin__InfluenzaA__ACZ98278

SEQ ID NO: 3917 - protein, 566 aa, Artificial Sequence; identical to SEQ ID NO: 3809
  hemagglutinin__InfluenzaA__ACZ98288

SEQ ID NO: 3918 - protein, 566 aa, Artificial Sequence
  hemagglutinin__InfluenzaA__ACZ98298
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3919 - protein, 566 aa, Artificial Sequence
  hemagglutinin__InfluenzaA__ACZ98318
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYHILAIYSTVASSLVLVVSLGAISFWMCSNGSLQCRICI

SEQ ID NO: 3920 - protein, 566 aa, Artificial Sequence; identical to SEQ ID NO: 2911
  hemagglutinin__InfluenzaA__ACZ98328

SEQ ID NO: 3921 - protein, 566 aa, Artificial Sequence; identical to SEQ ID NO: 2669
  hemagglutinin__InfluenzaA__ACZ98338

SEQ ID NO: 3922 - protein, 566 aa, Artificial Sequence; identical to SEQ ID NO: 3809
  hemagglutinin__InfluenzaA__ACZ98348

SEQ ID NO: 3923 - protein, 566 aa, Artificial Sequence; identical to SEQ ID NO: 2669
  hemagglutinin__InfluenzaA__ACZ98358

SEQ ID NO: 3924 - protein, 566 aa, Artificial Sequence; identical to SEQ ID NO: 2669
  hemagglutinin__InfluenzaA__ACZ98368

SEQ ID NO: 3925 - protein, 566 aa, Artificial Sequence; identical to SEQ ID NO: 2911
  hemagglutinin__InfluenzaA__ACZ98388

SEQ ID NO: 3926 - protein, 566 aa, Artificial Sequence; identical to SEQ ID NO: 2669
  hemagglutinin__InfluenzaA__ACZ98398

SEQ ID NO: 3927 - protein, 566 aa, Artificial Sequence; identical to SEQ ID NO: 2669
  hemagglutinin__InfluenzaA__ACZ98408

SEQ ID NO: 3928 - protein, 566 aa, Artificial Sequence; identical to SEQ ID NO: 2849
  hemagglutinin__InfluenzaA__ACZ98418

SEQ ID NO: 3929 - protein, 566 aa, Artificial Sequence; identical to SEQ ID NO: 2669
  hemagglutinin__InfluenzaA__ACZ98428

SEQ ID NO: 3930 - protein, 566 aa, Artificial Sequence; identical to SEQ ID NO: 2669
  hemagglutinin__InfluenzaA__ACZ98438

SEQ ID NO: 3931 - protein, 566 aa, Artificial Sequence; identical to SEQ ID NO: 2669
  hemagglutinin__InfluenzaA__ACZ98448

SEQ ID NO: 3932 - protein, 566 aa, Artificial Sequence; identical to SEQ ID NO: 3809
  hemagglutinin__InfluenzaA__ACZ98458

SEQ ID NO: 3933 - protein, 566 aa, Artificial Sequence
  hemagglutinin__InfluenzaA__ACZ98546
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLTTGLRNVPSIQYRGLFGAITGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3934 - protein, 566 aa, Artificial Sequence
  hemagglutinin__InfluenzaA__ACZ98560
MKAIRVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSPKLRLATGMRNVPFIQYRGLFGAITGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3935 - protein, 566 aa, Artificial Sequence
  hemagglutinin__InfluenzaA__ACZ98567
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSPKLRLASGMRNVPFIQSRGLFGAITGFIEEGWTGMVDGWYGFHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3936 - protein, 566 aa, Artificial Sequence; identical to SEQ ID NO: 2656
  hemagglutinin__InfluenzaA__ACZ98671

SEQ ID NO: 3937 - protein, 566 aa, Artificial Sequence; identical to SEQ ID NO: 2656
  hemagglutinin__InfluenzaA__ACZ98681

SEQ ID NO: 3938 - protein, 566 aa, Artificial Sequence; identical to SEQ ID NO: 2669
  hemagglutinin__InfluenzaA__ACZ98691

SEQ ID NO: 3939 - protein, 566 aa, Artificial Sequence
  hemagglutinin__InfluenzaA__ADA60799
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3940 - protein, 566 aa, Artificial Sequence; identical to SEQ ID NO: 3833
  hemagglutinin__InfluenzaA__ADA69302

SEQ ID NO: 3941 - protein, 566 aa, Artificial Sequence; identical to SEQ ID NO: 3833
  hemagglutinin__InfluenzaA__ADA69312

SEQ ID NO: 3942 - protein, 566 aa, Artificial Sequence; identical to SEQ ID NO: 3833
  hemagglutinin__InfluenzaA__ADA69322

SEQ ID NO: 3943 - protein, 566 aa, Artificial Sequence; identical to SEQ ID NO: 3833
  hemagglutinin__InfluenzaA__ADA69332

SEQ ID NO: 3944 - protein, 566 aa, Artificial Sequence; identical to SEQ ID NO: 3770
  hemagglutinin__InfluenzaA__ADA70329

SEQ ID NO: 3945 - protein, 565 aa, Artificial Sequence
  hemagglutinin__InfluenzaA__ADA71150
MKVKLLVLLCTFTATYADTICIGYHANNSTDTVDTVLEKNVTVTHSVNLVENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISNQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITKKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3946 - protein, 566 aa, Artificial Sequence
  hemagglutinin__InfluenzaA__ADA71152
MKTIIALSYILCLVFAQKLPGNDNSTATLCLGHHAVPNGTIVKTITNDQIEVTNATELVQSSSTGEICDSPHQILDGGNCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3947 - protein, 565 aa, Artificial Sequence
  hemagglutinin__InfluenzaA__ADA71154
MKVKLLVLLCTFTATYADTICIGYHANNSTDTVDTVLEKNVTVTHSVNLLENSHNGKLCLLKGIAPLQLGNCSVAGWILGNSECELLISKESWSYIVEKPNPENGTCYFGHFADYEELREQFGSVSSFERFEIFPKESSWPNHTVTGVSASCSHNGESSFYRNLLWLTGKNGLYPNLSKSYANNKEKEVLVLWGVHHPPSINDQKTLYHTENAYVSVVSSHYSRKFTPEIAKRPKVRDQEGRINYYWTLLEPRDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3948 - protein, 565 aa, Artificial Sequence
  hemagglutinin__InfluenzaA__ADA71158
MKVKLLVLLCTFTATYADTICIGYHANNSTDTVDTVLEKNVTVTHSVNLLENSHNGKLCLLKGIAPLQLGNCSVAGWILGNPECELLISKETWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSINDQRTLYHTENAYVSVVSSHYSRKFTPEIAKRPKVRDQEGRINYYWTLLEPRDTIIFEANGNLIAPRYAFALSRGFGSGIINSNAPMDKCDAKCQTPQGAINSSLPFQNVHPVTIGECPKYVRSAKLRMVTGLRNTPSIQSRGLFGAIAGFIEGGWTGMVDGWYGYHHQNEQGSGYAADQKSTQNAINGITNKVNSVIEKMNTQFTAVGKEFNKLESLMDILNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3949 - protein, 566 aa, Artificial Sequence; identical to SEQ ID NO: 2434
  hemagglutinin__InfluenzaA__ADA71162

SEQ ID NO: 3950 - protein, 565 aa, Artificial Sequence
  hemagglutinin__InfluenzaA__ADA71164
MKVKLLVLLCTFTATYADTICIGYHANNSTDTVDTVLEKNVTVTHSVNLLENSHNGKLCLLKGIAPLQLGNCSVAGWILGNPECELLVSKESWSYIVEKPNPENGTCYPGHFADYEELREQLSSVSSFERFEIFPKESSWPNHTVTGASASCSHNGENSFYRNLLWLTGKNGLYPNLSKSYANNKEKEVLVLWGVHHPPSIADQKTLYHTENAYVSVVSSHYSRKFTPEIAKRPKVRDQEGRIHYYWTLLEPGDTIIFEANGNLIAPRYAFALSRGFGSGIINSNAPMDKCDATCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVISQLKINAKDLGYGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3951 - protein, 565 aa, Artificial Sequence
  hemagglutinin__InfluenzaA__ADA71168
MKVKLLVLLCTFTATYADTICIGYHANNSTDTVDTVLEKNVTVTHSVNLLEDNHNGKLCLLKGKAPLQLGNCSVAGWILGNPECGLLISKESWSYIVERPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGVQMTLYHKENAYVSVVSSHYSRKFTPEIVKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3952 - protein, 565 aa, Artificial Sequence
  hemagglutinin__InfluenzaA__ADA71170
MKVKLLVLLCTFTATYADTICIGYHANNSTDTVDTVLEKNGTVTPSGNLVENSPNGKLCLLKGITPLQLGKCSVAGWILGNPKWELLVSKESWSYIGKKPNPENGTCYPGHFPYYEELREQLSSVSSFERFEIFPKESSWPNHTVTGASASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3953 - protein, 566 aa, Artificial Sequence
  hemagglutinin__InfluenzaA__ADA71172
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 3954 - protein, 565 aa, Artificial Sequence
  hemagglutinin__InfluenzaA__ADA71176
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGASASCSHNGENSFYRNLLWLTGKNGLYPNLSKSYANNKEKEVLVLWGVHHPPNIANQKTLYHTENAYVSVVSSHYSRKFTPEIAKRPKVRDQEGRINYYWTLLEPGDTIIFEANGNLIAPRYAFALSRGFGSGIINSNAPMDKCDATCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 3955 - protein, 566 aa, Artificial Sequence; identical to SEQ ID NO: 3770
  hemagglutinin__InfluenzaA__ADA71181

SEQ ID NO: 3956 - protein, 566 aa, Artificial Sequence; identical to SEQ ID NO: 3770
  hemagglutinin__InfluenzaA__ADA71191

SEQ ID NO: 3957 - protein, 566 aa, Artificial Sequence
  hemagglutinin__InfluenzaA__ADA79587
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3958 - protein, 566 aa, Artificial Sequence
  hemagglutinin__InfluenzaA__ADA79607
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3959 - protein, 566 aa, Artificial Sequence
  hemagglutinin__InfluenzaA__ADA83043
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3960 - protein, 566 aa, Artificial Sequence
  hemagglutinin__InfluenzaA__ADA83044
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSNNGTCYPGDFIDYEELREQLSSVSSFERFEIFPKTSSWPNHDSNKGVTAACPHAGAKSFYKNLIWLVKKENSYPKLNKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSDVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3961 - protein, 566 aa, Artificial Sequence; identical to SEQ ID NO: 2669
  hemagglutinin__InfluenzaA__ADA83580

SEQ ID NO: 3962 - protein, 566 aa, Artificial Sequence; identical to SEQ ID NO: 2669
  hemagglutinin__InfluenzaA__ADA83587

SEQ ID NO: 3963 - protein, 566 aa, Artificial Sequence
  hemagglutinin__InfluenzaA__ADA83591
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEISIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3964 - protein, 566 aa, Artificial Sequence; identical to SEQ ID NO: 3414
  hemagglutinin__InfluenzaA__ADA83595

SEQ ID NO: 3965 - protein, 566 aa, Artificial Sequence; identical to SEQ ID NO: 2669
  hemagglutinin__InfluenzaA__ADA83599

SEQ ID NO: 3966 - protein, 566 aa, Artificial Sequence; identical to SEQ ID NO: 2669
  hemagglutinin__InfluenzaA__ADA83603

SEQ ID NO: 3967 - protein, 566 aa, Artificial Sequence; identical to SEQ ID NO: 2669
  hemagglutinin__InfluenzaA__ADA83611

SEQ ID NO: 3968 - protein, 566 aa, Artificial Sequence
  hemagglutinin__InfluenzaA__ADA83615
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDLNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3969 - protein, 566 aa, Artificial Sequence
  hemagglutinin__InfluenzaA__ADA83622
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQRLYQNADAYVFVGTSRYSKKLKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3970 - protein, 566 aa, Artificial Sequence; identical to SEQ ID NO: 2669
  hemagglutinin__InfluenzaA__ADA83633

SEQ ID NO: 3971 - protein, 566 aa, Artificial Sequence; identical to SEQ ID NO: 2669
  hemagglutinin__InfluenzaA__ADA83637

SEQ ID NO: 3972 - protein, 566 aa, Artificial Sequence; identical to SEQ ID NO: 2669
  hemagglutinin__InfluenzaA__ADA83641

SEQ ID NO: 3973 - protein, 566 aa, Artificial Sequence; identical to SEQ ID NO: 2669
  hemagglutinin__InfluenzaA__ADA83645

SEQ ID NO: 3974 - protein, 566 aa, Artificial Sequence; identical to SEQ ID NO: 2669
  hemagglutinin__InfluenzaA__ADA83648

SEQ ID NO: 3975 - protein, 566 aa, Artificial Sequence; identical to SEQ ID NO: 2669
  hemagglutinin__InfluenzaA__ADA83656

SEQ ID NO: 3976 - protein, 566 aa, Artificial Sequence; identical to SEQ ID NO: 2669
  hemagglutinin__InfluenzaA__ADA83660

SEQ ID NO: 3977 - protein, 566 aa, Artificial Sequence
  hemagglutinin__InfluenzaA__ADA83664
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPETAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3978 - protein, 566 aa, Artificial Sequence
  hemagglutinin__InfluenzaA__ADA83668
MKAILVVLLYTFATANADTLCIGYHANNSTDTVDTVLEKNVTVTHSVNLLEDKHNGKLCKLRGVAPLHLGKCNIAGWILGNPECGSLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3979 - protein, 566 aa, Artificial Sequence; identical to SEQ ID NO: 2669
  hemagglutinin__InfluenzaA__ADA83672

SEQ ID NO: 3980 - protein, 566 aa, Artificial Sequence; identical to SEQ ID NO: 2669
  hemagglutinin__InfluenzaA__ADA83676

SEQ ID NO: 3981 - protein, 566 aa, Artificial Sequence; identical to SEQ ID NO: 2669
  hemagglutinin__InfluenzaA__ADA83680

SEQ ID NO: 3982 - protein, 566 aa, Artificial Sequence
  hemagglutinin__InfluenzaA__ADA86068
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSIKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3983 - protein, 566 aa, Artificial Sequence
  hemagglutinin__InfluenzaA__ADA86086
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTNADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3984 - protein, 566 aa, Artificial Sequence
  hemagglutinin__InfluenzaA__ADA86087
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETFSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGALNTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3985 - protein, 566 aa, Artificial Sequence; identical to SEQ ID NO: 3467
  hemagglutinin__InfluenzaA__ADA86088

SEQ ID NO: 3986 - protein, 566 aa, Artificial Sequence
  hemagglutinin__InfluenzaA__ADB03603
MKAILIVLLYTFATAHADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMDYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3987 - protein, 566 aa, Artificial Sequence; identical to SEQ ID NO: 2656
  hemagglutinin__InfluenzaA__ADB03604

SEQ ID NO: 3988 - protein, 566 aa, Artificial Sequence
  hemagglutinin__InfluenzaA__ADB03605
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMDYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3989 - protein, 566 aa, Artificial Sequence; identical to SEQ ID NO: 2669
  hemagglutinin__InfluenzaA__ADB03607

SEQ ID NO: 3990 - protein, 566 aa, Artificial Sequence; identical to SEQ ID NO: 3022
  hemagglutinin__InfluenzaA__ADB03609

SEQ ID NO: 3991 - protein, 566 aa, Artificial Sequence; identical to SEQ ID NO: 2669
  hemagglutinin__InfluenzaA__ADB03611

SEQ ID NO: 3992 - protein, 566 aa, Artificial Sequence
  hemagglutinin__InfluenzaA__ADB03612
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPFIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3993 - protein, 566 aa, Artificial Sequence; identical to SEQ ID NO: 2669
  hemagglutinin__InfluenzaA__ADB03614

SEQ ID NO: 3994 - protein, 566 aa, Artificial Sequence
  hemagglutinin__InfluenzaA__ADB03617
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 3995 - protein, 566 aa, Artificial Sequence; identical to SEQ ID NO: 3022
  hemagglutinin__InfluenzaA__ADB03619

SEQ ID NO: 3996 - protein, 566 aa, Artificial Sequence
  hemagglutinin__InfluenzaA__ADB03620
MKAILVVLLYTFATANADTLCIGYHANNSTDTVDTVLEKNVTVTHSVNLLEGKHNGKLCKLRGVAPLHLGKCNIAGWILGNPECESLSTASSWSYIVETSSSDNGTCYPGDFIDYEELREQLSSVSSFERFEIVPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3997 - protein, 566 aa, Artificial Sequence
  hemagglutinin__InfluenzaA__ADB03622
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 3998 - protein, 566 aa, Artificial Sequence; identical to SEQ ID NO: 3997
  hemagglutinin__InfluenzaA__ADB03623

SEQ ID NO: 3999 - protein, 566 aa, Artificial Sequence
  hemagglutinin__InfluenzaA__ADB03628
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4000 - protein, 566 aa, Artificial Sequence
  hemagglutinin__InfluenzaA__ADB03629
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGFHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4001 - protein, 566 aa, Artificial Sequence
  hemagglutinin__InfluenzaA__ADB03630
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 4002 - protein, 566 aa, Artificial Sequence; identical to SEQ ID NO: 3414
  hemagglutinin__InfluenzaA__ADB25319

SEQ ID NO: 4003 - protein, 566 aa, Artificial Sequence; identical to SEQ ID NO: 2669
  hemagglutinin__InfluenzaA__ADB25321

SEQ ID NO: 4004 - protein, 566 aa, Artificial Sequence
  hemagglutinin__InfluenzaA__ADB27970
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4005 - protein, 566 aa, Artificial Sequence; identical to SEQ ID NO: 2669
  hemagglutinin__InfluenzaA__ADB27980

SEQ ID NO: 4006 - protein, 566 aa, Artificial Sequence; identical to SEQ ID NO: 2669
  hemagglutinin__InfluenzaA__ADB54352

SEQ ID NO: 4007 - protein, 566 aa, Artificial Sequence; identical to SEQ ID NO: 2669
  hemagglutinin__InfluenzaA__ADB54355

SEQ ID NO: 4008 - protein, 565 aa, Artificial Sequence
  hemagglutinin__InfluenzaA__ADB65926
MKVKLLVLLCTFTATYADTICIGYHANNSTDTVDTVLEKNVTVTHSVNLLEDKHNGKLCLLKGKAPLQLGNCSVAGWILGNPECGLLISKESWSYIVERPNPENGTCYPGHFADYEELREQLSSVSSFERFEIFPKGSSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEMGNGCFEFYHKCNDECMESVKNGTYDYPKYSEESKLSREKIDGVKLESMGVYQILAIYSTVASSLVLLVSLGAIGFWMCSNGSLQCRICI

SEQ ID NO: 4009 - protein, 565 aa, Artificial Sequence
  hemagglutinin__InfluenzaA__ADB80153
MKVKLLALLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSFANNKEKEVLVLWGVHHPPNIGDQMTLYHKENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 4010 - protein, 566 aa, Artificial Sequence; identical to SEQ ID NO: 3770
  hemagglutinin__InfluenzaA__ADB81399

SEQ ID NO: 4011 - protein, 566 aa, Artificial Sequence; identical to SEQ ID NO: 3770
  hemagglutinin__InfluenzaA__ADB81409

SEQ ID NO: 4012 - protein, 566 aa, Artificial Sequence
  hemagglutinin__InfluenzaA__ADB81419
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPEYSEEAKLNREEIDGVKLESTRIYQILAIYSTVASSLVLVVSLGAISFWMCSNGSLQCRICI

SEQ ID NO: 4013 - protein, 566 aa, Artificial Sequence; identical to SEQ ID NO: 3829
  hemagglutinin__InfluenzaA__ADB81429

SEQ ID NO: 4014 - protein, 566 aa, Artificial Sequence
  hemagglutinin__InfluenzaA__ADB81439
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4015 - protein, 566 aa, Artificial Sequence
  hemagglutinin__InfluenzaA__ADB81449
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4016 - protein, 566 aa, Artificial Sequence
  hemagglutinin__InfluenzaA__ADB81459
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNGGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4017 - protein, 566 aa, Artificial Sequence
  hemagglutinin__InfluenzaA__ADB82655
MKAILLVLLCTLAAANADTLCIGYHANNSTDTVDTVLEKNVTVTHSVNLLEDRHNGKLCNLRGKAPLHLGKCNIAGWLLGNPECELLFAVNSWSYIVETSNSDNGTCYPGDFTSYEELREQLSSVSSFERFEIFPKASSWPNHETNRGVTAACPYAGTNGFYRNLIWLVKKENSYPKLRKSYVNNKKKEVLVLWGIHHPPTNTDQQSLYQNADAYVFVGSSKYSRKFKPEIAERPKVRGQAGRMNYYWTLIEPGDTITFEATGNLVAPRYAFAMNRGPVSGIITSDAPVHDCNATCQTPKGAINTSLPFQNIHPITIGECPKYVKSTRLRMATGLRNIPSIQSRGLFGAIAGFIEGGWTGMIDGWYGYHHQNGQGSGYAADQKSTQNAIDRITNKVNSVIEKMNIQFTAVGKEFNHLERRIENLNKKVDDGFLDVWTYNAELLVLLENERTLDFHDSNVKTLYEKVKTQLRNNAKEIGNGCFEFYHKCDDTCMESIKNGTYNYPKYSEESKLNREEIDGVKLESTRIYQILAIYSTAASSLVLLVSLGAIGFWMCSNGSLQCRICI

SEQ ID NO: 4018 - protein, 566 aa, Artificial Sequence
  hemagglutinin__InfluenzaA__ADB82656
MKAILLVLQCILTAANADTLCIGYHANNSTDTVDTVLEKNVTVTHSVNLLEDRHNGKLCKLKGIAPLHLGKCNIAGWLLGNPECELLFKANSWSYIVETSYSDNGTCYPGDFTNYEELREQLSSVSSFERFEMFPKANSWPNHETNKGVTAACPYAGANSFYRNLIWLVKKGNSYPRLSKSYVNNKKKEVLVLWGIHHPSTSTDQQSLYQNADAYVFVSSSTYNKRFKPEIGTRPKVRDQSGRMNYYWTIVEPGDTITFEATGNLVAPRYAFAMKRDSGSGIIMSDTPVHDCNTTCQTPKGAINTSLPFQNVHPVTIGECPKYVKSTKLRMATGLRNIPSIQSRGLFGAIAGFIEGGWTGMIDGWYGYHHQNEQGSGYAADRKSTQNAIDGITNKVNSIIEKMNIQFTAVGKEFSHLEKRVENLNKKVDDGFLDVWTYNAELLVLLENERTLDYHDSNVKNLYEKVRSQLKNNAKEIGNGCFEFYHKCDDSCMESIKNETYDYSKYSEESRLNREKIDGVKLESTQIYQILAIYSTVASSLVLLVSLGAISFWMCSNGSLQCRICI

SEQ ID NO: 4019 - protein, 566 aa, Artificial Sequence
  hemagglutinin__InfluenzaA__ADB82944
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4020 - protein, 566 aa, Artificial Sequence
  hemagglutinin__InfluenzaA__ADB82950
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFEPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4021 - protein, 566 aa, Artificial Sequence; identical to SEQ ID NO: 3467
  hemagglutinin__InfluenzaA__ADB89129

SEQ ID NO: 4022 - protein, 566 aa, Artificial Sequence; identical to SEQ ID NO: 2669
  hemagglutinin__InfluenzaA__ADB89139

SEQ ID NO: 4023 - protein, 566 aa, Artificial Sequence
  hemagglutinin__InfluenzaA__ADB89149
MKAILVVLLYTFATANAYTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHVGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4024 - protein, 566 aa, Artificial Sequence; identical to SEQ ID NO: 3022
  hemagglutinin__InfluenzaA__ADB89150

SEQ ID NO: 4025 - protein, 566 aa, Artificial Sequence
  hemagglutinin__InfluenzaA__ADB89221
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQNLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4026 - protein, 566 aa, Artificial Sequence; identical to SEQ ID NO: 2722
  hemagglutinin__InfluenzaA__ADB89241

SEQ ID NO: 4027 - protein, 566 aa, Artificial Sequence; identical to SEQ ID NO: 2669
  hemagglutinin__InfluenzaA__ADB89251

SEQ ID NO: 4028 - protein, 566 aa, Artificial Sequence; identical to SEQ ID NO: 3116
  hemagglutinin__InfluenzaA__ADB89261

SEQ ID NO: 4029 - protein, 566 aa, Artificial Sequence
  hemagglutinin__InfluenzaA__ADB89271
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMGSVKNGTYDYPKYSEEAKLNREEIDGVKLESTRIYQILAIYSTVASSLVLVVSLGAISFWMCSNGSLQCRICI

SEQ ID NO: 4030 - protein, 566 aa, Artificial Sequence
  hemagglutinin__InfluenzaA__ADB89281
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4031 - protein, 566 aa, Artificial Sequence; identical to SEQ ID NO: 2669
  hemagglutinin__InfluenzaA__ADB89291

SEQ ID NO: 4032 - protein, 566 aa, Artificial Sequence; identical to SEQ ID NO: 2669
  hemagglutinin__InfluenzaA__ADB89301

SEQ ID NO: 4033 - protein, 566 aa, Artificial Sequence; identical to SEQ ID NO: 2669
  hemagglutinin__InfluenzaA__ADB89311

SEQ ID NO: 4034 - protein, 566 aa, Artificial Sequence
  hemagglutinin__InfluenzaA__ADB89321
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSESYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4035 - protein, 566 aa, Artificial Sequence
  hemagglutinin__InfluenzaA__ADB89331
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 4036 - protein, 566 aa, Artificial Sequence; identical to SEQ ID NO: 2669
  hemagglutinin__InfluenzaA__ADB89341

SEQ ID NO: 4037 - protein, 566 aa, Artificial Sequence; identical to SEQ ID NO: 2669
  hemagglutinin__InfluenzaA__ADB89351

SEQ ID NO: 4038 - protein, 566 aa, Artificial Sequence; identical to SEQ ID NO: 2669
  hemagglutinin__InfluenzaA__ADB89361

SEQ ID NO: 4039 - protein, 566 aa, Artificial Sequence; identical to SEQ ID NO: 2669
  hemagglutinin__InfluenzaA__ADB89371

SEQ ID NO: 4040 - protein, 566 aa, Artificial Sequence; identical to SEQ ID NO: 3414
  hemagglutinin__InfluenzaA__ADB89381

SEQ ID NO: 4041 - protein, 566 aa, Artificial Sequence
  hemagglutinin__InfluenzaA__ADB89391
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACLHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMIDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4042 - protein, 566 aa, Artificial Sequence; identical to SEQ ID NO: 2656
  hemagglutinin__InfluenzaA__ADB89401

SEQ ID NO: 4043 - protein, 566 aa, Artificial Sequence; identical to SEQ ID NO: 2669
  hemagglutinin__InfluenzaA__ADB89411

SEQ ID NO: 4044 - protein, 566 aa, Artificial Sequence; identical to SEQ ID NO: 3116
  hemagglutinin__InfluenzaA__ADB89431

SEQ ID NO: 4045 - protein, 566 aa, Artificial Sequence; identical to SEQ ID NO: 3022
  hemagglutinin__InfluenzaA__ADB89441

SEQ ID NO: 4046 - protein, 566 aa, Artificial Sequence; identical to SEQ ID NO: 2669
  hemagglutinin__InfluenzaA__ADB89461

SEQ ID NO: 4047 - protein, 566 aa, Artificial Sequence; identical to SEQ ID NO: 3116
  hemagglutinin__InfluenzaA__ADB89481

SEQ ID NO: 4048 - protein, 566 aa, Artificial Sequence; identical to SEQ ID NO: 3116
  hemagglutinin__InfluenzaA__ADB89491

SEQ ID NO: 4049 - protein, 566 aa, Artificial Sequence
  hemagglutinin__InfluenzaA__ADB89501
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGLVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4050 - protein, 566 aa, Artificial Sequence; identical to SEQ ID NO: 2669
  hemagglutinin__InfluenzaA__ADB89511

SEQ ID NO: 4051 - protein, 566 aa, Artificial Sequence; identical to SEQ ID NO: 3116
  hemagglutinin__InfluenzaA__ADB89531

SEQ ID NO: 4052 - protein, 566 aa, Artificial Sequence; identical to SEQ ID NO: 3116
  hemagglutinin__InfluenzaA__ADB89541

SEQ ID NO: 4053 - protein, 566 aa, Artificial Sequence; identical to SEQ ID NO: 3829
  hemagglutinin__InfluenzaA__ADB89551

SEQ ID NO: 4054 - protein, 566 aa, Artificial Sequence; identical to SEQ ID NO: 2669
  hemagglutinin__InfluenzaA__ADB89561

SEQ ID NO: 4055 - protein, 566 aa, Artificial Sequence; identical to SEQ ID NO: 2669
  hemagglutinin__InfluenzaA__ADB89571

SEQ ID NO: 4056 - protein, 566 aa, Artificial Sequence; identical to SEQ ID NO: 2669
  hemagglutinin__InfluenzaA__ADB89581

SEQ ID NO: 4057 - protein, 566 aa, Artificial Sequence
  hemagglutinin__InfluenzaA__ADB89591
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWALVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4058 - protein, 566 aa, Artificial Sequence
  hemagglutinin__InfluenzaA__ADB89601
MKAIIVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILTIYSTVASSLVLVVSLGAISFWMCSNGSLQCRICI

SEQ ID NO: 4059 - protein, 566 aa, Artificial Sequence; identical to SEQ ID NO: 3833
  hemagglutinin__InfluenzaA__ADB89611

SEQ ID NO: 4060 - protein, 566 aa, Artificial Sequence; identical to SEQ ID NO: 3833
  hemagglutinin__InfluenzaA__ADB89621

SEQ ID NO: 4061 - protein, 566 aa, Artificial Sequence
  hemagglutinin__InfluenzaA__ADB89631
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4062 - protein, 566 aa, Artificial Sequence; identical to SEQ ID NO: 3833
  hemagglutinin__InfluenzaA__ADB89641

SEQ ID NO: 4063 - protein, 566 aa, Artificial Sequence; identical to SEQ ID NO: 2669
  hemagglutinin__InfluenzaA__ADB89651

SEQ ID NO: 4064 - protein, 566 aa, Artificial Sequence; identical to SEQ ID NO: 2669
  hemagglutinin__InfluenzaA__ADB89661

SEQ ID NO: 4065 - protein, 566 aa, Artificial Sequence; identical to SEQ ID NO: 3833
  hemagglutinin__InfluenzaA__ADB89671

SEQ ID NO: 4066 - protein, 566 aa, Artificial Sequence; identical to SEQ ID NO: 2669
  hemagglutinin__InfluenzaA__ADB89681

SEQ ID NO: 4067 - protein, 566 aa, Artificial Sequence; identical to SEQ ID NO: 2669
  hemagglutinin__InfluenzaA__ADB89691

SEQ ID NO: 4068 - protein, 566 aa, Artificial Sequence; identical to SEQ ID NO: 3771
  hemagglutinin__InfluenzaA__ADB89701

SEQ ID NO: 4069 - protein, 566 aa, Artificial Sequence
  hemagglutinin__InfluenzaA__ADB89711
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4070 - protein, 566 aa, Artificial Sequence
  hemagglutinin__InfluenzaA__ADB89721
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFDNESFNWTGVTQNGTSSACIRRSKNSFFSRLNWLTHLNFKYPALNVTMPNNEQFDKLYLWGVHHPGTDKDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4071 - protein, 566 aa, Artificial Sequence
  hemagglutinin__InfluenzaA__ADB90360
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSNNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4072 - protein, 566 aa, Artificial Sequence
  hemagglutinin__InfluenzaA__ADB90370
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4073 - protein, 566 aa, Artificial Sequence; identical to SEQ ID NO: 3588
  hemagglutinin__InfluenzaA__ADB90414

SEQ ID NO: 4074 - protein, 566 aa, Artificial Sequence; identical to SEQ ID NO: 3116
  hemagglutinin__InfluenzaA__ADC32409

SEQ ID NO: 4075 - protein, 566 aa, Artificial Sequence
  hemagglutinin__InfluenzaA__ADC32410
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENEKTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4076 - protein, 566 aa, Artificial Sequence
  hemagglutinin__InfluenzaA__ADC32411
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLAKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4077 - protein, 566 aa, Artificial Sequence; identical to SEQ ID NO: 3022
  hemagglutinin__InfluenzaA__ADC32412

SEQ ID NO: 4078 - protein, 566 aa, Artificial Sequence; identical to SEQ ID NO: 2669
  hemagglutinin__InfluenzaA__ADC32413

SEQ ID NO: 4079 - protein, 566 aa, Artificial Sequence; identical to SEQ ID NO: 3116
  hemagglutinin__InfluenzaA__ADC32414

SEQ ID NO: 4080 - protein, 566 aa, Artificial Sequence; identical to SEQ ID NO: 3116
  hemagglutinin__InfluenzaA__ADC32415

SEQ ID NO: 4081 - protein, 566 aa, Artificial Sequence; identical to SEQ ID NO: 3116
  hemagglutinin__InfluenzaA__ADC32416

SEQ ID NO: 4082 - protein, 566 aa, Artificial Sequence
  hemagglutinin__InfluenzaA__ADC32417
MKAILVVLLYTFATANADTLCIGYHANNSTDTVDTVLEKNVTVTHSVNLLEYKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCNNTCMESVKNGTYDYPKYSEEAKLNREEIDGVKLESTRIYQILAIYSTVASSLVLVVSLGAISFWMCSNGSLQCRICI

SEQ ID NO: 4083 - protein, 566 aa, Artificial Sequence; identical to SEQ ID NO: 3116
  hemagglutinin__InfluenzaA__ADC32418

SEQ ID NO: 4084 - protein, 566 aa, Artificial Sequence
  hemagglutinin__InfluenzaA__ADC32419
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWFGYHHQNDQGSAYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4085 - protein, 566 aa, Artificial Sequence; identical to SEQ ID NO: 3116
  hemagglutinin__InfluenzaA__ADC32420

SEQ ID NO: 4086 - protein, 566 aa, Artificial Sequence; identical to SEQ ID NO: 3116
  hemagglutinin__InfluenzaA__ADC32421

SEQ ID NO: 4087 - protein, 566 aa, Artificial Sequence
  hemagglutinin__InfluenzaA__ADC32422
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLMVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4088 - protein, 566 aa, Artificial Sequence
  hemagglutinin__InfluenzaA__ADC32423
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVNDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4089 - protein, 566 aa, Artificial Sequence
  hemagglutinin__InfluenzaA__ADC32434
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4090 - protein, 566 aa, Artificial Sequence; identical to SEQ ID NO: 4089
  hemagglutinin__InfluenzaA__ADC32435

SEQ ID NO: 4091 - protein, 566 aa, Artificial Sequence
  hemagglutinin__InfluenzaA__ADC34940
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNERFNWTGVTQNGTSSACKRGSDNSFFSRLNWLTHLKFKYPALNVTMPNNEKFDKLYIWGVHHPGTDNDQIFLHAQASGRITVSTKRSQQTVIPNIGSRPRVRNIPSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4092 - protein, 566 aa, Artificial Sequence; identical to SEQ ID NO: 4004
  hemagglutinin__InfluenzaA__ADC38987

SEQ ID NO: 4093 - protein, 566 aa, Artificial Sequence
  hemagglutinin__InfluenzaA__ADC38997
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKDVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4094 - protein, 566 aa, Artificial Sequence; identical to SEQ ID NO: 3770
  hemagglutinin__InfluenzaA__ADC39007

SEQ ID NO: 4095 - protein, 565 aa, Artificial Sequence
  hemagglutinin__InfluenzaA__ADC45604
MKAKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGLGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 4096 - protein, 565 aa, Artificial Sequence
  hemagglutinin__InfluenzaA__ADC45626
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGNQMTLYHKENAYVSVVSSHYSRKFTPEIAKRPKVRDQEGRINYYWTLLEPGDTIIFEASGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 4097 - protein, 565 aa, Artificial Sequence
  hemagglutinin__InfluenzaA__ADC45637
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQMTLYHKENAYVSVVSSHYSRKFTPEIAKRPKVRDQEGRINYYWTLLEPGDTIIFEASGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 4098 - protein, 565 aa, Artificial Sequence
  hemagglutinin__InfluenzaA__ADC45648
MKVKLLVLLCTFAATYADTICIGYHANNSTDTVDTVLEKNVTVTHSVNLLENSHNGKLCLLKGIAPLQLGNCSIAGWVLGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 4099 - protein, 565 aa, Artificial Sequence
  hemagglutinin__InfluenzaA__ADC45659
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKKSSWPNHTVTGVSASCSHNGESSFYRNLLWLTEKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 4100 - protein, 565 aa, Artificial Sequence
  hemagglutinin__InfluenzaA__ADC45670
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGGSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 4101 - protein, 565 aa, Artificial Sequence
  hemagglutinin__InfluenzaA__ADC45681
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSASSFERFEIFPKESSWPNHTVTGVSASCSHNGESSFYKNLLWLTGKNGLYPNLRKSYANNKEKEVLVLWGVHHPPNIGDQMTLYHKENAYVSVVSSHYSRKFTPEIAKRPKVRDQEGRINYYWTLLEPGDTIIFEASGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 4102 - protein, 565 aa, Artificial Sequence
  hemagglutinin__InfluenzaA__ADC45692
MKVKLLVLLCTFTATYADTICIGYHANNSTDTVDTVLEKNVTVTHSVNLLENSHNGKLCLLKGIAPLQLGNCSVAGWILGNPECELLISKKSWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 4103 - protein, 565 aa, Artificial Sequence; identical to SEQ ID NO: 3170
  hemagglutinin__InfluenzaA__ADC45703

SEQ ID NO: 4104 - protein, 565 aa, Artificial Sequence
  hemagglutinin__InfluenzaA__ADC45714
MKVKLLVLLCTFTATYADTICIGYHANNSTDTVDTVLEKNVTVTHSVNLLEDNHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTGKNGLYPNLSKSYANNKEKEVLVLWGVHHPPNIGDQTTLYHKENAYVSVVSSHYSRKFTPEIAKRPKVRDQEGRINYYWTLLEPGDTIIFEASGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDVWTYNAELLVLLENERTLDFHDSNVKNLYEKVKNQLKNNAKEIGNGCFEFYHKCNDECMESVKNGTYDYPKYSEESKLSREKIDGVKLESMGVYQILAIYSTVASSLVLLVSLGAISFWMCSNGSLQCRICI

SEQ ID NO: 4105 - protein, 565 aa, Artificial Sequence; identical to SEQ ID NO: 3170
  hemagglutinin__InfluenzaA__ADC45725

SEQ ID NO: 4106 - protein, 565 aa, Artificial Sequence
  hemagglutinin__InfluenzaA__ADC45736
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENTYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 4107 - protein, 565 aa, Artificial Sequence; identical to SEQ ID NO: 2488
  hemagglutinin__InfluenzaA__ADC45747

SEQ ID NO: 4108 - protein, 565 aa, Artificial Sequence
  hemagglutinin__InfluenzaA__ADC45758
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLNFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 4109 - protein, 565 aa, Artificial Sequence; identical to SEQ ID NO: 3626
  hemagglutinin__InfluenzaA__ADC45780

SEQ ID NO: 4110 - protein, 565 aa, Artificial Sequence; identical to SEQ ID NO: 3131
  hemagglutinin__InfluenzaA__ADC45791

SEQ ID NO: 4111 - protein, 565 aa, Artificial Sequence
  hemagglutinin__InfluenzaA__ADC45813
MKVKLLILLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTMKNGLYPNLSKSYANNKEKEVLVLWGVHHPPNIGDQKTLYNTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 4112 - protein, 565 aa, Artificial Sequence; identical to SEQ ID NO: 3131
  hemagglutinin__InfluenzaA__ADC45824

SEQ ID NO: 4113 - protein, 565 aa, Artificial Sequence
  hemagglutinin__InfluenzaA__ADC45835
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVTLESMGVYQILAIYSTVASSLVLLVSLGAISFWMCSNGSLQCRICI

SEQ ID NO: 4114 - protein, 565 aa, Artificial Sequence; identical to SEQ ID NO: 2488
  hemagglutinin__InfluenzaA__ADC45846

SEQ ID NO: 4115 - protein, 566 aa, Artificial Sequence; identical to SEQ ID NO: 2669
  hemagglutinin__InfluenzaA__ADC53558

SEQ ID NO: 4116 - protein, 566 aa, Artificial Sequence; identical to SEQ ID NO: 2760
  hemagglutinin__InfluenzaA__ADD14087

SEQ ID NO: 4117 - protein, 566 aa, Artificial Sequence; identical to SEQ ID NO: 2669
  hemagglutinin__InfluenzaA__ADD14089

SEQ ID NO: 4118 - protein, 566 aa, Artificial Sequence; identical to SEQ ID NO: 2669
  hemagglutinin__InfluenzaA__ADD14093

SEQ ID NO: 4119 - protein, 566 aa, Artificial Sequence
  hemagglutinin__InfluenzaA__ADD14095
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVLPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4120 - protein, 566 aa, Artificial Sequence; identical to SEQ ID NO: 2669
  hemagglutinin__InfluenzaA__ADD14097

SEQ ID NO: 4121 - protein, 566 aa, Artificial Sequence; identical to SEQ ID NO: 2669
  hemagglutinin__InfluenzaA__ADD14099

SEQ ID NO: 4122 - protein, 566 aa, Artificial Sequence; identical to SEQ ID NO: 2669
  hemagglutinin__InfluenzaA__ADD14101

SEQ ID NO: 4123 - protein, 566 aa, Artificial Sequence
  hemagglutinin__InfluenzaA__ADD14103
MKAILVVLLCTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLDKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4124 - protein, 566 aa, Artificial Sequence
  hemagglutinin__InfluenzaA__ADD14111
MKAILVVLLYTFATANADTLCIGYHANNSTDTVDTVLEKNVTVTHSVNLLEDKHNGKLCKLRGVAPLHLGKCNIAGWILGNPECESLSTASSWSYIVEISSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4125 - protein, 566 aa, Artificial Sequence; identical to SEQ ID NO: 2669
  hemagglutinin__InfluenzaA__ADD14115

SEQ ID NO: 4126 - protein, 566 aa, Artificial Sequence; identical to SEQ ID NO: 2669
  hemagglutinin__InfluenzaA__ADD14117

SEQ ID NO: 4127 - protein, 566 aa, Artificial Sequence; identical to SEQ ID NO: 2669
  hemagglutinin__InfluenzaA__ADD14119

SEQ ID NO: 4128 - protein, 566 aa, Artificial Sequence; identical to SEQ ID NO: 2669
  hemagglutinin__InfluenzaA__ADD14121

SEQ ID NO: 4129 - protein, 566 aa, Artificial Sequence; identical to SEQ ID NO: 2669
  hemagglutinin__InfluenzaA__ADD14123

SEQ ID NO: 4130 - protein, 566 aa, Artificial Sequence; identical to SEQ ID NO: 2669
  hemagglutinin__InfluenzaA__ADD14127

SEQ ID NO: 4131 - protein, 566 aa, Artificial Sequence
  hemagglutinin__InfluenzaA__ADD14129
MKAILVVLLYTFATANADTLCIGYHANNSTDTVDTVLEKNVTVTHSVNLLEDKHNGKLCKLRGVASLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4132 - protein, 566 aa, Artificial Sequence
  hemagglutinin__InfluenzaA__ADD14133
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNVDAYVFVGTSRYSKKFKPEIAIRPKVRDQEGRMNYYWTLVEPGDKITFEATGNLVVPRYAFAMERNAGFGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4133 - protein, 566 aa, Artificial Sequence; identical to SEQ ID NO: 2760
  hemagglutinin__InfluenzaA__ADD14135

SEQ ID NO: 4134 - protein, 566 aa, Artificial Sequence; identical to SEQ ID NO: 2669
  hemagglutinin__InfluenzaA__ADD14137

SEQ ID NO: 4135 - protein, 566 aa, Artificial Sequence; identical to SEQ ID NO: 3417
  hemagglutinin__InfluenzaA__ADD14139

SEQ ID NO: 4136 - protein, 566 aa, Artificial Sequence; identical to SEQ ID NO: 2669
  hemagglutinin__InfluenzaA__ADD14143

SEQ ID NO: 4137 - protein, 566 aa, Artificial Sequence; identical to SEQ ID NO: 2669
  hemagglutinin__InfluenzaA__ADD14145

SEQ ID NO: 4138 - protein, 566 aa, Artificial Sequence; identical to SEQ ID NO: 2669
  hemagglutinin__InfluenzaA__ADD14147

SEQ ID NO: 4139 - protein, 566 aa, Artificial Sequence
  hemagglutinin__InfluenzaA__ADD14151
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPRAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4140 - protein, 566 aa, Artificial Sequence; identical to SEQ ID NO: 2669
  hemagglutinin__InfluenzaA__ADD14153

SEQ ID NO: 4141 - protein, 566 aa, Artificial Sequence; identical to SEQ ID NO: 2669
  hemagglutinin__InfluenzaA__ADD14155

SEQ ID NO: 4142 - protein, 566 aa, Artificial Sequence; identical to SEQ ID NO: 2669
  hemagglutinin__InfluenzaA__ADD14157

SEQ ID NO: 4143 - protein, 566 aa, Artificial Sequence; identical to SEQ ID NO: 2669
  hemagglutinin__InfluenzaA__ADD14162

SEQ ID NO: 4144 - protein, 566 aa, Artificial Sequence; identical to SEQ ID NO: 2669
  hemagglutinin__InfluenzaA__ADD14172

SEQ ID NO: 4145 - protein, 566 aa, Artificial Sequence; identical to SEQ ID NO: 2669
  hemagglutinin__InfluenzaA__ADD14182

SEQ ID NO: 4146 - protein, 566 aa, Artificial Sequence; identical to SEQ ID NO: 2669
  hemagglutinin__InfluenzaA__ADD14192

SEQ ID NO: 4147 - protein, 566 aa, Artificial Sequence; identical to SEQ ID NO: 2669
  hemagglutinin__InfluenzaA__ADD14202

SEQ ID NO: 4148 - protein, 566 aa, Artificial Sequence
  hemagglutinin__InfluenzaA__ADD21447
MKAILVFLLYTFATANADTLCIGYHANNSTDTVDTVLEKNVTVTHSVNLLEDRHNGKLCKLRGVAPLHLGKCNIAGWLLGNPECELLFTASSWSYIVETSNSDNGTCYPGDFINYEELREQLSSVSSFERFEMFPKSSSWPNHETNRGVTAACPYAGANSFYRNLIWLVKKENSYPKLSKSYINNKEKEVLVLWGIHHPPTSADQQSLYQNADAYVFVGSSKYNKKFRPEIAARPKVRGQTGRMNYYWTLVEPGDTITFEATENLVVPRYAFAMKRGSGSGIIISDTPVHDCNTTCQTPKGAINTSLPFQNIHPVTIGECPKYVKSTNLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGLLDVWTYNAELLVLLENERTLDYHDSNVKNLYEKVRSQLKNNAKEIGNGCFEFYHKCDDTCMESVRNGAYDYPKYSEEAKLNREEIDGVKLESTRIYQILAIYSTVASSLVLLVSLGAISFWMCSNGSLQCRICI

SEQ ID NO: 4149 - protein, 566 aa, Artificial Sequence
  hemagglutinin__InfluenzaA__ADD21457
MKAILVFLLYTFATANADTLCIGYHANNSTDTVDTVLEKNVTVTHSVNLLEDRHNGKLCKLRGVAPLHLGKCNIAGWLLGNPECELLFTASSWSYIVETSNSDNGTCYPGDFINYEELREQLSSVSSFERFEMFPKSSSWPNHETNRGVTAACPYAGANSFYRNLIWLVKKENSYPKLSKSYINNKEKEVLVLWGIHHPPTSADQQSLYQNADAYVFVGSSKYNKKFRPEIAARPKVRGQTGRMNYYWTLVEPGDTITFEATGNLVVPRYAFAMKRGSGSGIIISDTPVHDCNTTCQTPKGAVNTSLPFQNIHPVTIGECPKYVKSTNLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGLLDVWTYNAELLVLLENERTLDYHDSNVKNLYEKVRSQLKNNAKEIGNGCFEFYHKCDDTCMESVRNGTYDYPKYSEEAKLNREEIDGVKLESTRIYQILAIYSTVASSLVLLVSLGAISFWMCSNGSLQCRICI

SEQ ID NO: 4150 - protein, 565 aa, Artificial Sequence
  hemagglutinin__InfluenzaA__ADD21467
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIRDQRALYHTENAYVSVVSSHYSRRFTPEIAKRPKVRGQEGRINYYWTLLEPGDTIIFEANGNLIAPWYAFALSRGFGSGIITSNAPMDECDAKCQTPQGAINSSLPFQNVHPVTIGECPKYARSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 4151 - protein, 566 aa, Artificial Sequence
  hemagglutinin__InfluenzaA__ADD21560
MKTIIAFSHILCLIYAQKLPGSDNSMATLCLGHHAVPNGTLVKTITDDQIEVTNATELVQSSSTGRICNSPHHILDGKNCTLIDALLGDPHCDDFQNKEWDLFVERSTAYSNCYPYYVPDYASLRSLVASSGTLEFTQESFNWTGVTQDGSSYTCRRKSVNSFFSRLNWLHNLDYKYPALNVTMPNNDKFDKLYIWGVHHPGTDRDQTNLYVQASGRVTVSTKRSQQTVIPNIGSRPWVRGVSSIISIYWTIVKPGDILLINSTGNLIAPRGYFKIQSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQITGKLNRVIKKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKSVQLKSGYKDWILWISFAMSCFLLCVVLLGFIMWTCQKGNIKCNICI

SEQ ID NO: 4152 - protein, 566 aa, Artificial Sequence; identical to SEQ ID NO: 2656
  hemagglutinin__InfluenzaA__ADD21734

SEQ ID NO: 4153 - protein, 566 aa, Artificial Sequence; identical to SEQ ID NO: 2669
  hemagglutinin__InfluenzaA__ADD21744

SEQ ID NO: 4154 - protein, 566 aa, Artificial Sequence
  hemagglutinin__InfluenzaA__ADD21764
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAESGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4155 - protein, 566 aa, Artificial Sequence
  hemagglutinin__InfluenzaA__ADD21774
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSVQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4156 - protein, 566 aa, Artificial Sequence; identical to SEQ ID NO: 2669
  hemagglutinin__InfluenzaA__ADD21784

SEQ ID NO: 4157 - protein, 566 aa, Artificial Sequence; identical to SEQ ID NO: 3829
  hemagglutinin__InfluenzaA__ADD21794

SEQ ID NO: 4158 - protein, 566 aa, Artificial Sequence; identical to SEQ ID NO: 2669
  hemagglutinin__InfluenzaA__ADD21804

SEQ ID NO: 4159 - protein, 566 aa, Artificial Sequence
  hemagglutinin__InfluenzaA__ADD21814
MKAILVVLLYTFATANADTLCIGYHANNSTDTVDTVLEKNVTVTHSVNLLEDKHNGKLCKLRGVAPLHLGKCNIASWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4160 - protein, 566 aa, Artificial Sequence; identical to SEQ ID NO: 3829
  hemagglutinin__InfluenzaA__ADD21824

SEQ ID NO: 4161 - protein, 566 aa, Artificial Sequence; identical to SEQ ID NO: 3829
  hemagglutinin__InfluenzaA__ADD21834

SEQ ID NO: 4162 - protein, 566 aa, Artificial Sequence; identical to SEQ ID NO: 3833
  hemagglutinin__InfluenzaA__ADD21844

SEQ ID NO: 4163 - protein, 566 aa, Artificial Sequence; identical to SEQ ID NO: 3833
  hemagglutinin__InfluenzaA__ADD21854

SEQ ID NO: 4164 - protein, 566 aa, Artificial Sequence; identical to SEQ ID NO: 3771
  hemagglutinin__InfluenzaA__ADD21864

SEQ ID NO: 4165 - protein, 566 aa, Artificial Sequence
  hemagglutinin__InfluenzaA__ADD21884
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMGSVKNGTYDYPKYSEEAKLNREEIDGVKLESTRIYQILAIYSTVASSLVLVVSLGAISFWMCSNGSLQCRICI

SEQ ID NO: 4166 - protein, 566 aa, Artificial Sequence; identical to SEQ ID NO: 3771
  hemagglutinin__InfluenzaA__ADD21894

SEQ ID NO: 4167 - protein, 566 aa, Artificial Sequence
  hemagglutinin__InfluenzaA__ADD22501
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRIQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4168 - protein, 566 aa, Artificial Sequence; identical to SEQ ID NO: 3771
  hemagglutinin__InfluenzaA__ADD22511

SEQ ID NO: 4169 - protein, 566 aa, Artificial Sequence
  hemagglutinin__InfluenzaA__ADD22521
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4170 - protein, 566 aa, Artificial Sequence; identical to SEQ ID NO: 2669
  hemagglutinin__InfluenzaA__ADD22531

SEQ ID NO: 4171 - protein, 566 aa, Artificial Sequence
  hemagglutinin__InfluenzaA__ADD22541
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4172 - protein, 566 aa, Artificial Sequence; identical to SEQ ID NO: 3771
  hemagglutinin__InfluenzaA__ADD22554

SEQ ID NO: 4173 - protein, 566 aa, Artificial Sequence; identical to SEQ ID NO: 3771
  hemagglutinin__InfluenzaA__ADD22564

SEQ ID NO: 4174 - protein, 566 aa, Artificial Sequence
  hemagglutinin__InfluenzaA__ADD22574
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTLKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4175 - protein, 566 aa, Artificial Sequence; identical to SEQ ID NO: 3771
  hemagglutinin__InfluenzaA__ADD22584

SEQ ID NO: 4176 - protein, 566 aa, Artificial Sequence; identical to SEQ ID NO: 2669
  hemagglutinin__InfluenzaA__ADD22594

SEQ ID NO: 4177 - protein, 566 aa, Artificial Sequence; identical to SEQ ID NO: 3771
  hemagglutinin__InfluenzaA__ADD22604

SEQ ID NO: 4178 - protein, 566 aa, Artificial Sequence; identical to SEQ ID NO: 3771
  hemagglutinin__InfluenzaA__ADD22614

SEQ ID NO: 4179 - protein, 566 aa, Artificial Sequence; identical to SEQ ID NO: 3771
  hemagglutinin__InfluenzaA__ADD22624

SEQ ID NO: 4180 - protein, 566 aa, Artificial Sequence
  hemagglutinin__InfluenzaA__ADD22634
MKAILVVLLCTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4181 - protein, 566 aa, Artificial Sequence
  hemagglutinin__InfluenzaA__ADD22645
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIEGVKLESTRIYQILAIYSTVASSLVLVVSLGAISFWMCSNGSLQCRICI

SEQ ID NO: 4182 - protein, 566 aa, Artificial Sequence
  hemagglutinin__InfluenzaA__ADD22665
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKRKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4183 - protein, 566 aa, Artificial Sequence; identical to SEQ ID NO: 3771
  hemagglutinin__InfluenzaA__ADD22675

SEQ ID NO: 4184 - protein, 566 aa, Artificial Sequence; identical to SEQ ID NO: 3771
  hemagglutinin__InfluenzaA__ADD22685

SEQ ID NO: 4185 - protein, 566 aa, Artificial Sequence; identical to SEQ ID NO: 3771
  hemagglutinin__InfluenzaA__ADD22695

SEQ ID NO: 4186 - protein, 566 aa, Artificial Sequence
  hemagglutinin__InfluenzaA__ADD22722
MKAILVVLLYTFATANADTLCIGYHANNSTDTVDTVLEKNVTVTHSVNLLEDRHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSSYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4187 - protein, 566 aa, Artificial Sequence; identical to SEQ ID NO: 4169
  hemagglutinin__InfluenzaA__ADD22732

SEQ ID NO: 4188 - protein, 566 aa, Artificial Sequence
  hemagglutinin__InfluenzaA__ADD22742
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSSYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4189 - protein, 566 aa, Artificial Sequence; identical to SEQ ID NO: 2669
  hemagglutinin__InfluenzaA__ADD22752

SEQ ID NO: 4190 - protein, 566 aa, Artificial Sequence; identical to SEQ ID NO: 2760
  hemagglutinin__InfluenzaA__ADD22762

SEQ ID NO: 4191 - protein, 566 aa, Artificial Sequence; identical to SEQ ID NO: 3771
  hemagglutinin__InfluenzaA__ADD22772

SEQ ID NO: 4192 - protein, 566 aa, Artificial Sequence; identical to SEQ ID NO: 3771
  hemagglutinin__InfluenzaA__ADD22782

SEQ ID NO: 4193 - protein, 566 aa, Artificial Sequence
  hemagglutinin__InfluenzaA__ADD22792
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4194 - protein, 566 aa, Artificial Sequence; identical to SEQ ID NO: 4169
  hemagglutinin__InfluenzaA__ADD22802

SEQ ID NO: 4195 - protein, 566 aa, Artificial Sequence; identical to SEQ ID NO: 3771
  hemagglutinin__InfluenzaA__ADD22812

SEQ ID NO: 4196 - protein, 566 aa, Artificial Sequence
  hemagglutinin__InfluenzaA__ADD22822
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSADNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNMCMESVKNGTYDYPKYSEEAKLNREEIDGVKLESTRIYQILAIYSTVASSLVLVVSLGAISFWMCSNGSLQCRICI

SEQ ID NO: 4197 - protein, 566 aa, Artificial Sequence; identical to SEQ ID NO: 3771
  hemagglutinin__InfluenzaA__ADD22832

SEQ ID NO: 4198 - protein, 566 aa, Artificial Sequence; identical to SEQ ID NO: 3771
  hemagglutinin__InfluenzaA__ADD22842

SEQ ID NO: 4199 - protein, 566 aa, Artificial Sequence
  hemagglutinin__InfluenzaA__ADD22852
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4200 - protein, 566 aa, Artificial Sequence
  hemagglutinin__InfluenzaA__ADD22941
MKAILVVLLYTFATANADTLCIGYHANNSTDTVDTVLEKNVTVTHSVNLLEDKHNGKLCKLRGVAPLHLGKCNIAGWILGNPECESLSTAISWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4201 - protein, 566 aa, Artificial Sequence; identical to SEQ ID NO: 3771
  hemagglutinin__InfluenzaA__ADD22951

SEQ ID NO: 4202 - protein, 566 aa, Artificial Sequence; identical to SEQ ID NO: 3771
  hemagglutinin__InfluenzaA__ADD22961

SEQ ID NO: 4203 - protein, 566 aa, Artificial Sequence; identical to SEQ ID NO: 3771
  hemagglutinin__InfluenzaA__ADD22971

SEQ ID NO: 4204 - protein, 566 aa, Artificial Sequence; identical to SEQ ID NO: 3771
  hemagglutinin__InfluenzaA__ADD23072

SEQ ID NO: 4205 - protein, 566 aa, Artificial Sequence
  hemagglutinin__InfluenzaA__ADD23082
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4206 - protein, 566 aa, Artificial Sequence
  hemagglutinin__InfluenzaA__ADD23102
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFEKFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4207 - protein, 566 aa, Artificial Sequence; identical to SEQ ID NO: 3771
  hemagglutinin__InfluenzaA__ADD23112

SEQ ID NO: 4208 - protein, 566 aa, Artificial Sequence; identical to SEQ ID NO: 3771
  hemagglutinin__InfluenzaA__ADD23122

SEQ ID NO: 4209 - protein, 566 aa, Artificial Sequence; identical to SEQ ID NO: 2669
  hemagglutinin__InfluenzaA__ADD23132

SEQ ID NO: 4210 - protein, 566 aa, Artificial Sequence; identical to SEQ ID NO: 3833
  hemagglutinin__InfluenzaA__ADD23142

SEQ ID NO: 4211 - protein, 566 aa, Artificial Sequence
  hemagglutinin__InfluenzaA__ADD23162
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQGLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4212 - protein, 566 aa, Artificial Sequence; identical to SEQ ID NO: 3833
  hemagglutinin__InfluenzaA__ADD23172

SEQ ID NO: 4213 - protein, 566 aa, Artificial Sequence; identical to SEQ ID NO: 3833
  hemagglutinin__InfluenzaA__ADD23182

SEQ ID NO: 4214 - protein, 566 aa, Artificial Sequence; identical to SEQ ID NO: 3833
  hemagglutinin__InfluenzaA__ADD23192

SEQ ID NO: 4215 - protein, 566 aa, Artificial Sequence; identical to SEQ ID NO: 3833
  hemagglutinin__InfluenzaA__ADD23202

SEQ ID NO: 4216 - protein, 566 aa, Artificial Sequence; identical to SEQ ID NO: 3833
  hemagglutinin__InfluenzaA__ADD23220

SEQ ID NO: 4217 - protein, 566 aa, Artificial Sequence; identical to SEQ ID NO: 3829
  hemagglutinin__InfluenzaA__ADD23230

SEQ ID NO: 4218 - protein, 566 aa, Artificial Sequence; identical to SEQ ID NO: 3833
  hemagglutinin__InfluenzaA__ADD23240

SEQ ID NO: 4219 - protein, 566 aa, Artificial Sequence
  hemagglutinin__InfluenzaA__ADD23260
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4220 - protein, 566 aa, Artificial Sequence; identical to SEQ ID NO: 3022
  hemagglutinin__InfluenzaA__ADD23280

SEQ ID NO: 4221 - protein, 566 aa, Artificial Sequence
  hemagglutinin__InfluenzaA__ADD23290
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4222 - protein, 566 aa, Artificial Sequence; identical to SEQ ID NO: 3833
  hemagglutinin__InfluenzaA__ADD23300

SEQ ID NO: 4223 - protein, 566 aa, Artificial Sequence; identical to SEQ ID NO: 4221
  hemagglutinin__InfluenzaA__ADD23310

SEQ ID NO: 4224 - protein, 566 aa, Artificial Sequence; identical to SEQ ID NO: 3833
  hemagglutinin__InfluenzaA__ADD23320

SEQ ID NO: 4225 - protein, 566 aa, Artificial Sequence
  hemagglutinin__InfluenzaA__ADD23330
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4226 - protein, 566 aa, Artificial Sequence
  hemagglutinin__InfluenzaA__ADD23355
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFEMFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4227 - protein, 566 aa, Artificial Sequence; identical to SEQ ID NO: 4221
  hemagglutinin__InfluenzaA__ADD23375

SEQ ID NO: 4228 - protein, 566 aa, Artificial Sequence; identical to SEQ ID NO: 3833
  hemagglutinin__InfluenzaA__ADD23385

SEQ ID NO: 4229 - protein, 566 aa, Artificial Sequence
  hemagglutinin__InfluenzaA__ADD23405
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITVGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4230 - protein, 566 aa, Artificial Sequence
  hemagglutinin__InfluenzaA__ADD23415
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAESGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4231 - protein, 566 aa, Artificial Sequence; identical to SEQ ID NO: 3833
  hemagglutinin__InfluenzaA__ADD23435

SEQ ID NO: 4232 - protein, 566 aa, Artificial Sequence
  hemagglutinin__InfluenzaA__ADD23465
MKAILAVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4233 - protein, 566 aa, Artificial Sequence; identical to SEQ ID NO: 3833
  hemagglutinin__InfluenzaA__ADD23475

SEQ ID NO: 4234 - protein, 566 aa, Artificial Sequence; identical to SEQ ID NO: 3833
  hemagglutinin__InfluenzaA__ADD23485

SEQ ID NO: 4235 - protein, 566 aa, Artificial Sequence
  hemagglutinin__InfluenzaA__ADD23495
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGARSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4236 - protein, 566 aa, Artificial Sequence
  hemagglutinin__InfluenzaA__ADD23505
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLIEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4237 - protein, 566 aa, Artificial Sequence; identical to SEQ ID NO: 3833
  hemagglutinin__InfluenzaA__ADD23515

SEQ ID NO: 4238 - protein, 566 aa, Artificial Sequence; identical to SEQ ID NO: 3833
  hemagglutinin__InfluenzaA__ADD23994

SEQ ID NO: 4239 - protein, 566 aa, Artificial Sequence
  hemagglutinin__InfluenzaA__ADD24004
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4240 - protein, 566 aa, Artificial Sequence; identical to SEQ ID NO: 3771
  hemagglutinin__InfluenzaA__ADD24014

SEQ ID NO: 4241 - protein, 566 aa, Artificial Sequence
  hemagglutinin__InfluenzaA__ADD52537
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4242 - protein, 566 aa, Artificial Sequence; identical to SEQ ID NO: 3833
  hemagglutinin__InfluenzaA__ADD64203

SEQ ID NO: 4243 - protein, 566 aa, Artificial Sequence
  hemagglutinin__InfluenzaA__ADD64204
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLIEPGEKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAREIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4244 - protein, 566 aa, Artificial Sequence; identical to SEQ ID NO: 2669
  hemagglutinin__InfluenzaA__ADD64205

SEQ ID NO: 4245 - protein, 566 aa, Artificial Sequence; identical to SEQ ID NO: 2669
  hemagglutinin__InfluenzaA__ADD64206

SEQ ID NO: 4246 - protein, 566 aa, Artificial Sequence; identical to SEQ ID NO: 3467
  hemagglutinin__InfluenzaA__ADD64207

SEQ ID NO: 4247 - protein, 566 aa, Artificial Sequence
  hemagglutinin__InfluenzaA__ADD64208
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDPNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4248 - protein, 566 aa, Artificial Sequence; identical to SEQ ID NO: 3467
  hemagglutinin__InfluenzaA__ADD64209

SEQ ID NO: 4249 - protein, 566 aa, Artificial Sequence; identical to SEQ ID NO: 2669
  hemagglutinin__InfluenzaA__ADD64210

SEQ ID NO: 4250 - protein, 566 aa, Artificial Sequence; identical to SEQ ID NO: 3467
  hemagglutinin__InfluenzaA__ADD64211

SEQ ID NO: 4251 - protein, 566 aa, Artificial Sequence; identical to SEQ ID NO: 2669
  hemagglutinin__InfluenzaA__ADD64212

SEQ ID NO: 4252 - protein, 566 aa, Artificial Sequence; identical to SEQ ID NO: 3467
  hemagglutinin__InfluenzaA__ADD64213

SEQ ID NO: 4253 - protein, 566 aa, Artificial Sequence
  hemagglutinin__InfluenzaA__ADD64214
MKAILVVLLYTFATANADTLCIGYHANNSTDTVDTVLEKNVTVTHSVNLLENKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4254 - protein, 566 aa, Artificial Sequence; identical to SEQ ID NO: 2669
  hemagglutinin__InfluenzaA__ADD64215

SEQ ID NO: 4255 - protein, 566 aa, Artificial Sequence; identical to SEQ ID NO: 3467
  hemagglutinin__InfluenzaA__ADD64216

SEQ ID NO: 4256 - protein, 566 aa, Artificial Sequence; identical to SEQ ID NO: 3467
  hemagglutinin__InfluenzaA__ADD64217

SEQ ID NO: 4257 - protein, 566 aa, Artificial Sequence
  hemagglutinin__InfluenzaA__ADD74350
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4258 - protein, 566 aa, Artificial Sequence
  hemagglutinin__InfluenzaA__ADD74360
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKRKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4259 - protein, 566 aa, Artificial Sequence; identical to SEQ ID NO: 2669
  hemagglutinin__InfluenzaA__ADD74370

SEQ ID NO: 4260 - protein, 566 aa, Artificial Sequence; identical to SEQ ID NO: 2669
  hemagglutinin__InfluenzaA__ADD74398

SEQ ID NO: 4261 - protein, 566 aa, Artificial Sequence
  hemagglutinin__InfluenzaA__ADD74428
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4262 - protein, 566 aa, Artificial Sequence
  hemagglutinin__InfluenzaA__ADD74438
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLEPTRIYQILAIYSTVASSLVLVVSLGAISFWMCSNGSLQCRICI

SEQ ID NO: 4263 - protein, 566 aa, Artificial Sequence; identical to SEQ ID NO: 2669
  hemagglutinin__InfluenzaA__ADD74448

SEQ ID NO: 4264 - protein, 566 aa, Artificial Sequence; identical to SEQ ID NO: 2669
  hemagglutinin__InfluenzaA__ADD74458

SEQ ID NO: 4265 - protein, 566 aa, Artificial Sequence
  hemagglutinin__InfluenzaA__ADD74468
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEITIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4266 - protein, 566 aa, Artificial Sequence
  hemagglutinin__InfluenzaA__ADD74488
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4267 - protein, 566 aa, Artificial Sequence; identical to SEQ ID NO: 2669
  hemagglutinin__InfluenzaA__ADD74498

SEQ ID NO: 4268 - protein, 566 aa, Artificial Sequence
  hemagglutinin__InfluenzaA__ADD74508
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAEAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4269 - protein, 566 aa, Artificial Sequence
  hemagglutinin__InfluenzaA__ADD74518
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMERNTGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4270 - protein, 566 aa, Artificial Sequence
  hemagglutinin__InfluenzaA__ADD74528
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFQPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4271 - protein, 566 aa, Artificial Sequence
  hemagglutinin__InfluenzaA__ADD74538
MKAILVVLLYTFATANADTLCIGYHANNSTDTVDTVLEKNVTVTHSVNLLEDKHNGKLCRLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVYDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4272 - protein, 566 aa, Artificial Sequence; identical to SEQ ID NO: 4266
  hemagglutinin__InfluenzaA__ADD74548

SEQ ID NO: 4273 - protein, 566 aa, Artificial Sequence; identical to SEQ ID NO: 3833
  hemagglutinin__InfluenzaA__ADD74558

SEQ ID NO: 4274 - protein, 566 aa, Artificial Sequence; identical to SEQ ID NO: 4221
  hemagglutinin__InfluenzaA__ADD74568

SEQ ID NO: 4275 - protein, 566 aa, Artificial Sequence
  hemagglutinin__InfluenzaA__ADD74578
MKAILVVLLYTFATANADTLCIGYHANNSTDTVDTVLEKNVTVTHSVNLLEDKHNGKLCKLRGVAPLHLGKCNIAGWILGNPECESLSTSSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4276 - protein, 566 aa, Artificial Sequence
  hemagglutinin__InfluenzaA__ADD74588
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSDGQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 4277 - protein, 566 aa, Artificial Sequence; identical to SEQ ID NO: 4221
  hemagglutinin__InfluenzaA__ADD74598

SEQ ID NO: 4278 - protein, 566 aa, Artificial Sequence; identical to SEQ ID NO: 4221
  hemagglutinin__InfluenzaA__ADD74608

SEQ ID NO: 4279 - protein, 566 aa, Artificial Sequence; identical to SEQ ID NO: 3833
  hemagglutinin__InfluenzaA__ADD74618

SEQ ID NO: 4280 - protein, 566 aa, Artificial Sequence
  hemagglutinin__InfluenzaA__ADD74628
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4281 - protein, 566 aa, Artificial Sequence; identical to SEQ ID NO: 3770
  hemagglutinin__InfluenzaA__ADD74648

SEQ ID NO: 4282 - protein, 566 aa, Artificial Sequence
  hemagglutinin__InfluenzaA__ADD74658
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4283 - protein, 566 aa, Artificial Sequence; identical to SEQ ID NO: 4221
  hemagglutinin__InfluenzaA__ADD74668

SEQ ID NO: 4284 - protein, 566 aa, Artificial Sequence; identical to SEQ ID NO: 4261
  hemagglutinin__InfluenzaA__ADD74678

SEQ ID NO: 4285 - protein, 566 aa, Artificial Sequence; identical to SEQ ID NO: 4221
  hemagglutinin__InfluenzaA__ADD74688

SEQ ID NO: 4286 - protein, 566 aa, Artificial Sequence
  hemagglutinin__InfluenzaA__ADD74698
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4287 - protein, 566 aa, Artificial Sequence; identical to SEQ ID NO: 4221
  hemagglutinin__InfluenzaA__ADD74708

SEQ ID NO: 4288 - protein, 566 aa, Artificial Sequence
  hemagglutinin__InfluenzaA__ADD74728
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSVVLVVSLGAISFWMCSNGSLQCRICI

SEQ ID NO: 4289 - protein, 566 aa, Artificial Sequence
  hemagglutinin__InfluenzaA__ADD74738
MKAILVVLLYTFATANADTLCIGYHANNSTDTVDTVLEKNVTVTHSVNLLEDKHNGKLCKLRGVAPLHLGKCNIAGWILGNPECESLSTARSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSGYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4290 - protein, 566 aa, Artificial Sequence; identical to SEQ ID NO: 3833
  hemagglutinin__InfluenzaA__ADD74748

SEQ ID NO: 4291 - protein, 566 aa, Artificial Sequence; identical to SEQ ID NO: 3833
  hemagglutinin__InfluenzaA__ADD74758

SEQ ID NO: 4292 - protein, 566 aa, Artificial Sequence
  hemagglutinin__InfluenzaA__ADD74768
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMSYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4293 - protein, 566 aa, Artificial Sequence; identical to SEQ ID NO: 3833
  hemagglutinin__InfluenzaA__ADD74778

SEQ ID NO: 4294 - protein, 566 aa, Artificial Sequence; identical to SEQ ID NO: 4221
  hemagglutinin__InfluenzaA__ADD74788

SEQ ID NO: 4295 - protein, 566 aa, Artificial Sequence; identical to SEQ ID NO: 4221
  hemagglutinin__InfluenzaA__ADD74798

SEQ ID NO: 4296 - protein, 566 aa, Artificial Sequence
  hemagglutinin__InfluenzaA__ADD74808
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 4297 - protein, 566 aa, Artificial Sequence
  hemagglutinin__InfluenzaA__ADD74818
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4298 - protein, 566 aa, Artificial Sequence
  hemagglutinin__InfluenzaA__ADD74838
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4299 - protein, 566 aa, Artificial Sequence
  hemagglutinin__InfluenzaA__ADD74848
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 4300 - protein, 566 aa, Artificial Sequence
  hemagglutinin__InfluenzaA__ADD74858
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGTKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4301 - protein, 566 aa, Artificial Sequence; identical to SEQ ID NO: 4221
  hemagglutinin__InfluenzaA__ADD74868

SEQ ID NO: 4302 - protein, 566 aa, Artificial Sequence; identical to SEQ ID NO: 4221
  hemagglutinin__InfluenzaA__ADD74878

SEQ ID NO: 4303 - protein, 566 aa, Artificial Sequence
  hemagglutinin__InfluenzaA__ADD74888
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4304 - protein, 566 aa, Artificial Sequence
  hemagglutinin__InfluenzaA__ADD74898
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4305 - protein, 566 aa, Artificial Sequence
  hemagglutinin__InfluenzaA__ADD74908
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4306 - protein, 566 aa, Artificial Sequence; identical to SEQ ID NO: 4299
  hemagglutinin__InfluenzaA__ADD74918

SEQ ID NO: 4307 - protein, 566 aa, Artificial Sequence; identical to SEQ ID NO: 4221
  hemagglutinin__InfluenzaA__ADD74928

SEQ ID NO: 4308 - protein, 566 aa, Artificial Sequence; identical to SEQ ID NO: 4299
  hemagglutinin__InfluenzaA__ADD74938

SEQ ID NO: 4309 - protein, 566 aa, Artificial Sequence
  hemagglutinin__InfluenzaA__ADD74958
MKAILVVLLYTFATANADTLCIGYHANNSTDTVDTVLEKNVTVTHSVNLLENKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4310 - protein, 566 aa, Artificial Sequence; identical to SEQ ID NO: 3833
  hemagglutinin__InfluenzaA__ADD74968

SEQ ID NO: 4311 - protein, 566 aa, Artificial Sequence
  hemagglutinin__InfluenzaA__ADD74998
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNERGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4312 - protein, 566 aa, Artificial Sequence; identical to SEQ ID NO: 3833
  hemagglutinin__InfluenzaA__ADD75008

SEQ ID NO: 4313 - protein, 566 aa, Artificial Sequence; identical to SEQ ID NO: 3833
  hemagglutinin__InfluenzaA__ADD75018

SEQ ID NO: 4314 - protein, 566 aa, Artificial Sequence; identical to SEQ ID NO: 3833
  hemagglutinin__InfluenzaA__ADD75028

SEQ ID NO: 4315 - protein, 566 aa, Artificial Sequence; identical to SEQ ID NO: 3770
  hemagglutinin__InfluenzaA__ADD75058

SEQ ID NO: 4316 - protein, 566 aa, Artificial Sequence; identical to SEQ ID NO: 4089
  hemagglutinin__InfluenzaA__ADD75088

SEQ ID NO: 4317 - protein, 566 aa, Artificial Sequence; identical to SEQ ID NO: 2669
  hemagglutinin__InfluenzaA__ADD75098

SEQ ID NO: 4318 - protein, 566 aa, Artificial Sequence
  hemagglutinin__InfluenzaA__ADD75108
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4319 - protein, 566 aa, Artificial Sequence; identical to SEQ ID NO: 2669
  hemagglutinin__InfluenzaA__ADD75118

SEQ ID NO: 4320 - protein, 566 aa, Artificial Sequence; identical to SEQ ID NO: 3116
  hemagglutinin__InfluenzaA__ADD75128

SEQ ID NO: 4321 - protein, 566 aa, Artificial Sequence; identical to SEQ ID NO: 2669
  hemagglutinin__InfluenzaA__ADD75138

SEQ ID NO: 4322 - protein, 566 aa, Artificial Sequence; identical to SEQ ID NO: 3833
  hemagglutinin__InfluenzaA__ADD75148

SEQ ID NO: 4323 - protein, 566 aa, Artificial Sequence; identical to SEQ ID NO: 2669
  hemagglutinin__InfluenzaA__ADD75158

SEQ ID NO: 4324 - protein, 566 aa, Artificial Sequence
  hemagglutinin__InfluenzaA__ADD84494
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKISSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHGCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4325 - protein, 566 aa, Artificial Sequence
  hemagglutinin__InfluenzaA__ADD84495
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKISSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4326 - protein, 566 aa, Artificial Sequence
  hemagglutinin__InfluenzaA__ADD84496
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKISSWPNHDPNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4327 - protein, 566 aa, Artificial Sequence; identical to SEQ ID NO: 4325
  hemagglutinin__InfluenzaA__ADD84497

SEQ ID NO: 4328 - protein, 566 aa, Artificial Sequence
  hemagglutinin__InfluenzaA__ADD84498
MKAILVVLLYTFATANADTLCIGYHANNSTDTVVTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKISSWPNHDPNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4329 - protein, 566 aa, Artificial Sequence; identical to SEQ ID NO: 4325
  hemagglutinin__InfluenzaA__ADD84499

SEQ ID NO: 4330 - protein, 566 aa, Artificial Sequence
  hemagglutinin__InfluenzaA__ADD92535
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNRVNSVIEKMNTQFTAVGKEFNHLEKRIENLNKKVDGGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4331 - protein, 566 aa, Artificial Sequence; identical to SEQ ID NO: 4257
  hemagglutinin__InfluenzaA__ADD96766

SEQ ID NO: 4332 - protein, 566 aa, Artificial Sequence; identical to SEQ ID NO: 2849
  hemagglutinin__InfluenzaA__ADD96776

SEQ ID NO: 4333 - protein, 566 aa, Artificial Sequence; identical to SEQ ID NO: 2849
  hemagglutinin__InfluenzaA__ADD96786

SEQ ID NO: 4334 - protein, 566 aa, Artificial Sequence; identical to SEQ ID NO: 4154
  hemagglutinin__InfluenzaA__ADD96796

SEQ ID NO: 4335 - protein, 566 aa, Artificial Sequence
  hemagglutinin__InfluenzaA__ADD96806
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4336 - protein, 566 aa, Artificial Sequence; identical to SEQ ID NO: 3833
  hemagglutinin__InfluenzaA__ADD96816

SEQ ID NO: 4337 - protein, 566 aa, Artificial Sequence
  hemagglutinin__InfluenzaA__ADD96826
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVMDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFAAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4338 - protein, 566 aa, Artificial Sequence; identical to SEQ ID NO: 2669
  hemagglutinin__InfluenzaA__ADD96836

SEQ ID NO: 4339 - protein, 566 aa, Artificial Sequence; identical to SEQ ID NO: 2669
  hemagglutinin__InfluenzaA__ADD96846

SEQ ID NO: 4340 - protein, 566 aa, Artificial Sequence; identical to SEQ ID NO: 4221
  hemagglutinin__InfluenzaA__ADD96856

SEQ ID NO: 4341 - protein, 566 aa, Artificial Sequence; identical to SEQ ID NO: 3022
  hemagglutinin__InfluenzaA__ADD96886

SEQ ID NO: 4342 - protein, 566 aa, Artificial Sequence; identical to SEQ ID NO: 4296
  hemagglutinin__InfluenzaA__ADD96896

SEQ ID NO: 4343 - protein, 566 aa, Artificial Sequence; identical to SEQ ID NO: 3833
  hemagglutinin__InfluenzaA__ADD96906

SEQ ID NO: 4344 - protein, 566 aa, Artificial Sequence; identical to SEQ ID NO: 3833
  hemagglutinin__InfluenzaA__ADD96916

SEQ ID NO: 4345 - protein, 566 aa, Artificial Sequence; identical to SEQ ID NO: 3833
  hemagglutinin__InfluenzaA__ADD96926

SEQ ID NO: 4346 - protein, 566 aa, Artificial Sequence
  hemagglutinin__InfluenzaA__ADD96936
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLIKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4347 - protein, 566 aa, Artificial Sequence
  hemagglutinin__InfluenzaA__ADD96946
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFKRFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4348 - protein, 566 aa, Artificial Sequence
  hemagglutinin__InfluenzaA__ADD96956
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVKPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4349 - protein, 566 aa, Artificial Sequence; identical to SEQ ID NO: 2669
  hemagglutinin__InfluenzaA__ADD96976

SEQ ID NO: 4350 - protein, 566 aa, Artificial Sequence; identical to SEQ ID NO: 2669
  hemagglutinin__InfluenzaA__ADD96986

SEQ ID NO: 4351 - protein, 566 aa, Artificial Sequence
  hemagglutinin__InfluenzaA__ADD97035
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4352 - protein, 566 aa, Artificial Sequence
  hemagglutinin__InfluenzaA__ADD97045
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFTDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4353 - protein, 566 aa, Artificial Sequence; identical to SEQ ID NO: 4352
  hemagglutinin__InfluenzaA__ADD97055

SEQ ID NO: 4354 - protein, 566 aa, Artificial Sequence; identical to SEQ ID NO: 4352
  hemagglutinin__InfluenzaA__ADD97123

SEQ ID NO: 4355 - protein, 566 aa, Artificial Sequence
  hemagglutinin__InfluenzaA__ADD97161
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGKSYPKLSKSYINDKGKKVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4356 - protein, 566 aa, Artificial Sequence
  hemagglutinin__InfluenzaA__ADD97171
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAVSFWMCSNGSLQCRICI

SEQ ID NO: 4357 - protein, 566 aa, Artificial Sequence; identical to SEQ ID NO: 2669
  hemagglutinin__InfluenzaA__ADD97181

SEQ ID NO: 4358 - protein, 566 aa, Artificial Sequence; identical to SEQ ID NO: 2669
  hemagglutinin__InfluenzaA__ADD97201

SEQ ID NO: 4359 - protein, 566 aa, Artificial Sequence; identical to SEQ ID NO: 4352
  hemagglutinin__InfluenzaA__ADD97211

SEQ ID NO: 4360 - protein, 566 aa, Artificial Sequence; identical to SEQ ID NO: 2669
  hemagglutinin__InfluenzaA__ADD97231

SEQ ID NO: 4361 - protein, 566 aa, Artificial Sequence
  hemagglutinin__InfluenzaA__ADD97241
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFTDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4362 - protein, 566 aa, Artificial Sequence; identical to SEQ ID NO: 4352
  hemagglutinin__InfluenzaA__ADD97251

SEQ ID NO: 4363 - protein, 566 aa, Artificial Sequence; identical to SEQ ID NO: 2669
  hemagglutinin__InfluenzaA__ADD97261

SEQ ID NO: 4364 - protein, 566 aa, Artificial Sequence
  hemagglutinin__InfluenzaA__ADD97271
MKAILVVLLYTFATANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4365 - protein, 566 aa, Artificial Sequence; identical to SEQ ID NO: 4356
  hemagglutinin__InfluenzaA__ADD97281

SEQ ID NO: 4366 - protein, 566 aa, Artificial Sequence; identical to SEQ ID NO: 2669
  hemagglutinin__InfluenzaA__ADD97291

SEQ ID NO: 4367 - protein, 566 aa, Artificial Sequence
  hemagglutinin__InfluenzaA__ADD97311
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTIADQQSLYQNADAYVFVGTSRYSKKFKPEIAIRPKVRDQEGRMKYYWTLVEPGDKITFEATGNLVVPRYAFAMERNAGSGIIISDTPVHNCNTTCQTSKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4368 - protein, 566 aa, Artificial Sequence; identical to SEQ ID NO: 4352
  hemagglutinin__InfluenzaA__ADD97321

SEQ ID NO: 4369 - protein, 566 aa, Artificial Sequence; identical to SEQ ID NO: 3833
  hemagglutinin__InfluenzaA__ADD97331

SEQ ID NO: 4370 - protein, 566 aa, Artificial Sequence
  hemagglutinin__InfluenzaA__ADD97341
MKAILVVLLYTFATVNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4371 - protein, 566 aa, Artificial Sequence; identical to SEQ ID NO: 3833
  hemagglutinin__InfluenzaA__ADD97351

SEQ ID NO: 4372 - protein, 566 aa, Artificial Sequence; identical to SEQ ID NO: 3833
  hemagglutinin__InfluenzaA__ADD97361

SEQ ID NO: 4373 - protein, 566 aa, Artificial Sequence
  hemagglutinin__InfluenzaA__ADD97371
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRVCI

SEQ ID NO: 4374 - protein, 566 aa, Artificial Sequence; identical to SEQ ID NO: 3833
  hemagglutinin__InfluenzaA__ADD97381

SEQ ID NO: 4375 - protein, 566 aa, Artificial Sequence; identical to SEQ ID NO: 2669
  hemagglutinin__InfluenzaA__ADD97391

SEQ ID NO: 4376 - protein, 566 aa, Artificial Sequence; identical to SEQ ID NO: 3833
  hemagglutinin__InfluenzaA__ADD97411

SEQ ID NO: 4377 - protein, 566 aa, Artificial Sequence; identical to SEQ ID NO: 3833
  hemagglutinin__InfluenzaA__ADD97421

SEQ ID NO: 4378 - protein, 566 aa, Artificial Sequence; identical to SEQ ID NO: 2669
  hemagglutinin__InfluenzaA__ADD97431

SEQ ID NO: 4379 - protein, 566 aa, Artificial Sequence
  hemagglutinin__InfluenzaA__ADD97441
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4380 - protein, 566 aa, Artificial Sequence; identical to SEQ ID NO: 4373
  hemagglutinin__InfluenzaA__ADD97451

SEQ ID NO: 4381 - protein, 566 aa, Artificial Sequence; identical to SEQ ID NO: 4373
  hemagglutinin__InfluenzaA__ADD97461

SEQ ID NO: 4382 - protein, 566 aa, Artificial Sequence; identical to SEQ ID NO: 4221
  hemagglutinin__InfluenzaA__ADD97471

SEQ ID NO: 4383 - protein, 566 aa, Artificial Sequence; identical to SEQ ID NO: 4221
  hemagglutinin__InfluenzaA__ADD97481

SEQ ID NO: 4384 - protein, 566 aa, Artificial Sequence
  hemagglutinin__InfluenzaA__ADD97491
MKAILVVLLYTFATANADTLCIGYHANNSTDTVDTVLEKNVTVTHSVNLLEDKHNGKLCKLRGEAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4385 - protein, 566 aa, Artificial Sequence; identical to SEQ ID NO: 4384
  hemagglutinin__InfluenzaA__ADD97501

SEQ ID NO: 4386 - protein, 566 aa, Artificial Sequence; identical to SEQ ID NO: 3022
  hemagglutinin__InfluenzaA__ADD97511

SEQ ID NO: 4387 - protein, 566 aa, Artificial Sequence
  hemagglutinin__InfluenzaA__ADD97531
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTIADQQSLYQNADAYVFVGTSRYSKKFKPEIAIRPKVRDQEGRMKYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4388 - protein, 566 aa, Artificial Sequence
  hemagglutinin__InfluenzaA__ADD97541
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHTGAKSFYKNLIWLVKKGNSYPKLSKSYINDKGKEVLVLWGIHHPSTSTDQQSLYQNADAHVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4389 - protein, 566 aa, Artificial Sequence; identical to SEQ ID NO: 4221
  hemagglutinin__InfluenzaA__ADD97551

SEQ ID NO: 4390 - protein, 566 aa, Artificial Sequence; identical to SEQ ID NO: 3833
  hemagglutinin__InfluenzaA__ADD97561

SEQ ID NO: 4391 - protein, 566 aa, Artificial Sequence
  hemagglutinin__InfluenzaA__ADD97571
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSLFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4392 - protein, 566 aa, Artificial Sequence; identical to SEQ ID NO: 2669
  hemagglutinin__InfluenzaA__ADD97581

SEQ ID NO: 4393 - protein, 566 aa, Artificial Sequence; identical to SEQ ID NO: 2669
  hemagglutinin__InfluenzaA__ADD97591

SEQ ID NO: 4394 - protein, 566 aa, Artificial Sequence; identical to SEQ ID NO: 2669
  hemagglutinin__InfluenzaA__ADD97688

SEQ ID NO: 4395 - protein, 566 aa, Artificial Sequence; identical to SEQ ID NO: 4221
  hemagglutinin__InfluenzaA__ADD97698

SEQ ID NO: 4396 - protein, 566 aa, Artificial Sequence; identical to SEQ ID NO: 4221
  hemagglutinin__InfluenzaA__ADD97888

SEQ ID NO: 4397 - protein, 566 aa, Artificial Sequence
  hemagglutinin__InfluenzaA__ADD97898
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4398 - protein, 566 aa, Artificial Sequence; identical to SEQ ID NO: 3022
  hemagglutinin__InfluenzaA__ADD97908

SEQ ID NO: 4399 - protein, 566 aa, Artificial Sequence; identical to SEQ ID NO: 3833
  hemagglutinin__InfluenzaA__ADD97918

SEQ ID NO: 4400 - protein, 566 aa, Artificial Sequence
  hemagglutinin__InfluenzaA__ADD97928
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFHHKCDNTCMESVKNGTYDYPKYSEEAKLNREEIDGVKLESTRIYQILAIYSTVASSLVLVVSLGAISFWMCSNGSLQCRICI

SEQ ID NO: 4401 - protein, 566 aa, Artificial Sequence
  hemagglutinin__InfluenzaA__ADD97938
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPMTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4402 - protein, 566 aa, Artificial Sequence
  hemagglutinin__InfluenzaA__ADD97948
MKAILLVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4403 - protein, 566 aa, Artificial Sequence
  hemagglutinin__InfluenzaA__ADD97958
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFQPEIAIRPKVRDQEGRMNYYWTLLEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4404 - protein, 566 aa, Artificial Sequence; identical to SEQ ID NO: 2669
  hemagglutinin__InfluenzaA__ADD97968

SEQ ID NO: 4405 - protein, 566 aa, Artificial Sequence; identical to SEQ ID NO: 4397
  hemagglutinin__InfluenzaA__ADD97978

SEQ ID NO: 4406 - protein, 566 aa, Artificial Sequence; identical to SEQ ID NO: 4351
  hemagglutinin__InfluenzaA__ADD97988

SEQ ID NO: 4407 - protein, 566 aa, Artificial Sequence
  hemagglutinin__InfluenzaA__ADD97998
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKASSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFEMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4408 - protein, 566 aa, Artificial Sequence; identical to SEQ ID NO: 4221
  hemagglutinin__InfluenzaA__ADD98008

SEQ ID NO: 4409 - protein, 566 aa, Artificial Sequence
  hemagglutinin__InfluenzaA__ADD98018
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIATRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4410 - protein, 566 aa, Artificial Sequence; identical to SEQ ID NO: 4373
  hemagglutinin__InfluenzaA__ADD98028

SEQ ID NO: 4411 - protein, 566 aa, Artificial Sequence
  hemagglutinin__InfluenzaA__ADD98038
MKAILVVLLYTFATANADTLCIGYHANNSTDTVDTVLEKNVTVTHSVNLLEDKHNGKLCKLRGVAPLHLGKCNIAGWILGNPECESISTASSWSYIVETSSSDNGTCYPGDFIDYEELREQLSSVSSFERFEIFPKASSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFEMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4412 - protein, 566 aa, Artificial Sequence; identical to SEQ ID NO: 4397
  hemagglutinin__InfluenzaA__ADD98048

SEQ ID NO: 4413 - protein, 566 aa, Artificial Sequence; identical to SEQ ID NO: 2669
  hemagglutinin__InfluenzaA__ADD98058

SEQ ID NO: 4414 - protein, 566 aa, Artificial Sequence; identical to SEQ ID NO: 2669
  hemagglutinin__InfluenzaA__ADD98068

SEQ ID NO: 4415 - protein, 566 aa, Artificial Sequence; identical to SEQ ID NO: 2911
  hemagglutinin__InfluenzaA__ADD98078

SEQ ID NO: 4416 - protein, 566 aa, Artificial Sequence
  hemagglutinin__InfluenzaA__ADD98098
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSSDQQSLYQNADAYVFVGTSRYSKKFKPEIAIRPKVRDQEGRMNYYWTLVEPGDKITFEATGNLVVPRYAFAVERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4417 - protein, 566 aa, Artificial Sequence; identical to SEQ ID NO: 4384
  hemagglutinin__InfluenzaA__ADD98118

SEQ ID NO: 4418 - protein, 566 aa, Artificial Sequence; identical to SEQ ID NO: 4384
  hemagglutinin__InfluenzaA__ADD98128

SEQ ID NO: 4419 - protein, 566 aa, Artificial Sequence
  hemagglutinin__InfluenzaA__ADD98138
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNTGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4420 - protein, 566 aa, Artificial Sequence
  hemagglutinin__InfluenzaA__ADD98148
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIFISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4421 - protein, 566 aa, Artificial Sequence
  hemagglutinin__InfluenzaA__ADD98158
MKAILVVLLYTFATANADTLCIGYHANNSTDTVDTVLEKNVTVTHSVNLLEDKHNGKLCELRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVIPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4422 - protein, 566 aa, Artificial Sequence
  hemagglutinin__InfluenzaA__ADD98168
MKAILVVLLYTFATANADTLCIGYHANNSTDTVDTVLEKNVTVTHSINILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPKYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4423 - protein, 566 aa, Artificial Sequence; identical to SEQ ID NO: 3841
  hemagglutinin__InfluenzaA__ADD98188

SEQ ID NO: 4424 - protein, 566 aa, Artificial Sequence
  hemagglutinin__InfluenzaA__ADD98198
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKMRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4425 - protein, 566 aa, Artificial Sequence; identical to SEQ ID NO: 2669
  hemagglutinin__InfluenzaA__ADD98208

SEQ ID NO: 4426 - protein, 566 aa, Artificial Sequence; identical to SEQ ID NO: 2849
  hemagglutinin__InfluenzaA__ADE20321

SEQ ID NO: 4427 - protein, 566 aa, Artificial Sequence; identical to SEQ ID NO: 2849
  hemagglutinin__InfluenzaA__ADE20331

SEQ ID NO: 4428 - protein, 566 aa, Artificial Sequence; identical to SEQ ID NO: 2849
  hemagglutinin__InfluenzaA__ADE20341

SEQ ID NO: 4429 - protein, 566 aa, Artificial Sequence; identical to SEQ ID NO: 4257
  hemagglutinin__InfluenzaA__ADE20351

SEQ ID NO: 4430 - protein, 566 aa, Artificial Sequence; identical to SEQ ID NO: 2849
  hemagglutinin__InfluenzaA__ADE20375

SEQ ID NO: 4431 - protein, 566 aa, Artificial Sequence; identical to SEQ ID NO: 4257
  hemagglutinin__InfluenzaA__ADE20388

SEQ ID NO: 4432 - protein, 566 aa, Artificial Sequence; identical to SEQ ID NO: 2849
  hemagglutinin__InfluenzaA__ADE20628

SEQ ID NO: 4433 - protein, 566 aa, Artificial Sequence; identical to SEQ ID NO: 4257
  hemagglutinin__InfluenzaA__ADE20638

SEQ ID NO: 4434 - protein, 566 aa, Artificial Sequence; identical to SEQ ID NO: 2849
  hemagglutinin__InfluenzaA__ADE20648

SEQ ID NO: 4435 - protein, 566 aa, Artificial Sequence; identical to SEQ ID NO: 2849
  hemagglutinin__InfluenzaA__ADE20658

SEQ ID NO: 4436 - protein, 566 aa, Artificial Sequence; identical to SEQ ID NO: 4257
  hemagglutinin__InfluenzaA__ADE20668

SEQ ID NO: 4437 - protein, 566 aa, Artificial Sequence; identical to SEQ ID NO: 4257
  hemagglutinin__InfluenzaA__ADE20678

SEQ ID NO: 4438 - protein, 566 aa, Artificial Sequence; identical to SEQ ID NO: 2849
  hemagglutinin__InfluenzaA__ADE20688

SEQ ID NO: 4439 - protein, 566 aa, Artificial Sequence; identical to SEQ ID NO: 2849
  hemagglutinin__InfluenzaA__ADE20708

SEQ ID NO: 4440 - protein, 566 aa, Artificial Sequence; identical to SEQ ID NO: 2849
  hemagglutinin__InfluenzaA__ADE20718

SEQ ID NO: 4441 - protein, 566 aa, Artificial Sequence
  hemagglutinin__InfluenzaA__ADE20728
MKAILVVLLYTFATANADTLCIGYHANNSTDTVDTVLEKNVTVTHSVNILEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4442 - protein, 566 aa, Artificial Sequence; identical to SEQ ID NO: 2849
  hemagglutinin__InfluenzaA__ADE20738

SEQ ID NO: 4443 - protein, 566 aa, Artificial Sequence; identical to SEQ ID NO: 2849
  hemagglutinin__InfluenzaA__ADE20748

SEQ ID NO: 4444 - protein, 566 aa, Artificial Sequence; identical to SEQ ID NO: 4441
  hemagglutinin__InfluenzaA__ADE20758

SEQ ID NO: 4445 - protein, 566 aa, Artificial Sequence; identical to SEQ ID NO: 2849
  hemagglutinin__InfluenzaA__ADE20768

SEQ ID NO: 4446 - protein, 566 aa, Artificial Sequence
  hemagglutinin__InfluenzaA__ADE20778
MKAILVVLLYTFATANADTLCIGYHANNSTDTVDTVLEKNVTVTHSVNILEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKKVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4447 - protein, 566 aa, Artificial Sequence; identical to SEQ ID NO: 3833
  hemagglutinin__InfluenzaA__ADE20788

SEQ ID NO: 4448 - protein, 566 aa, Artificial Sequence
  hemagglutinin__InfluenzaA__ADE20808
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKEKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4449 - protein, 566 aa, Artificial Sequence; identical to SEQ ID NO: 3833
  hemagglutinin__InfluenzaA__ADE20818

SEQ ID NO: 4450 - protein, 566 aa, Artificial Sequence; identical to SEQ ID NO: 4391
  hemagglutinin__InfluenzaA__ADE20828

SEQ ID NO: 4451 - protein, 566 aa, Artificial Sequence
  hemagglutinin__InfluenzaA__ADE20848
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMIDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4452 - protein, 566 aa, Artificial Sequence; identical to SEQ ID NO: 3833
  hemagglutinin__InfluenzaA__ADE20858

SEQ ID NO: 4453 - protein, 566 aa, Artificial Sequence
  hemagglutinin__InfluenzaA__ADE20868
MKAILVVLLYTFATANADTLCIGYHANNSTDTVDTVLEKNVTVTHSVNLLEGKHNGKLCKLRGVAPLHLGKCNIAGWILGNPECESLTTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4454 - protein, 566 aa, Artificial Sequence; identical to SEQ ID NO: 4387
  hemagglutinin__InfluenzaA__ADE20878

SEQ ID NO: 4455 - protein, 566 aa, Artificial Sequence; identical to SEQ ID NO: 3771
  hemagglutinin__InfluenzaA__ADE20888

SEQ ID NO: 4456 - protein, 566 aa, Artificial Sequence
  hemagglutinin__InfluenzaA__ADE20898
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMEGVKNGTYDYPKYSEEAKLNREEIDGVKLESTRIYQILAIYSTVASSLVLVVSLGAISFWMCSNGSLQCRICI

SEQ ID NO: 4457 - protein, 566 aa, Artificial Sequence; identical to SEQ ID NO: 4420
  hemagglutinin__InfluenzaA__ADE20908

SEQ ID NO: 4458 - protein, 566 aa, Artificial Sequence
  hemagglutinin__InfluenzaA__ADE20918
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWILVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4459 - protein, 566 aa, Artificial Sequence; identical to SEQ ID NO: 3022
  hemagglutinin__InfluenzaA__ADE20928

SEQ ID NO: 4460 - protein, 566 aa, Artificial Sequence
  hemagglutinin__InfluenzaA__ADE20948
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4461 - protein, 566 aa, Artificial Sequence
  hemagglutinin__InfluenzaA__ADE20968
MKAILVVLLYTFATANADTLCIGYHANNSTDTVDTVLEKNVTVTHSVNLLEDKHNGKLCKLRGEAPLHLGKCNIAGWILGNPECESLSTASSWSYIVETSSSDNGTCYPGDFINYEELREQLSSVSSFERFEIFPKTSSWPNHDSNKGVTAACPHSGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4462 - protein, 566 aa, Artificial Sequence; identical to SEQ ID NO: 3833
  hemagglutinin__InfluenzaA__ADE20978

SEQ ID NO: 4463 - protein, 566 aa, Artificial Sequence
  hemagglutinin__InfluenzaA__ADE20988
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLKREEIDGVKLESTRIYQILAIYSTVASSLVLVVSLGAISFWMCSNGSLQCRICI

SEQ ID NO: 4464 - protein, 566 aa, Artificial Sequence; identical to SEQ ID NO: 3833
  hemagglutinin__InfluenzaA__ADE20998

SEQ ID NO: 4465 - protein, 566 aa, Artificial Sequence; identical to SEQ ID NO: 3997
  hemagglutinin__InfluenzaA__ADE21008

SEQ ID NO: 4466 - protein, 566 aa, Artificial Sequence
  hemagglutinin__InfluenzaA__ADE21018
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4467 - protein, 566 aa, Artificial Sequence; identical to SEQ ID NO: 4407
  hemagglutinin__InfluenzaA__ADE21028

SEQ ID NO: 4468 - protein, 566 aa, Artificial Sequence; identical to SEQ ID NO: 4397
  hemagglutinin__InfluenzaA__ADE21038

SEQ ID NO: 4469 - protein, 566 aa, Artificial Sequence; identical to SEQ ID NO: 4420
  hemagglutinin__InfluenzaA__ADE21048

SEQ ID NO: 4470 - protein, 566 aa, Artificial Sequence
  hemagglutinin__InfluenzaA__ADE21058
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRINYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4471 - protein, 566 aa, Artificial Sequence
  hemagglutinin__InfluenzaA__ADE21068
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKETGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4472 - protein, 565 aa, Artificial Sequence
  hemagglutinin__InfluenzaA__ADE28761
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGNQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHESNVKNLYEKVKSQLKNNAKEIGNGCFEFYHKCNDECMESVKNGTYDYPKYSEESKLNREKIDGVKLESMEVYQILAIYSTVASSLVLLVSLGAISFWMCSNGSLQCRICI

SEQ ID NO: 4473 - protein, 566 aa, Artificial Sequence; identical to SEQ ID NO: 2849
  hemagglutinin__InfluenzaA__ADE28780

SEQ ID NO: 4474 - protein, 566 aa, Artificial Sequence; identical to SEQ ID NO: 4257
  hemagglutinin__InfluenzaA__ADE28790

SEQ ID NO: 4475 - protein, 566 aa, Artificial Sequence; identical to SEQ ID NO: 4441
  hemagglutinin__InfluenzaA__ADE28800

SEQ ID NO: 4476 - protein, 566 aa, Artificial Sequence; identical to SEQ ID NO: 3833
  hemagglutinin__InfluenzaA__ADE28810

SEQ ID NO: 4477 - protein, 566 aa, Artificial Sequence
  hemagglutinin__InfluenzaA__ADE28820
MKAILVVLLYTFATANADTLCIGYHANNSTDTVDTVLEKNVTVTHSVNLLEDKHNGKLCKLRGVAPLHLGKCNIAGWILGSPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4478 - protein, 566 aa, Artificial Sequence; identical to SEQ ID NO: 2849
  hemagglutinin__InfluenzaA__ADE28830

SEQ ID NO: 4479 - protein, 566 aa, Artificial Sequence; identical to SEQ ID NO: 2849
  hemagglutinin__InfluenzaA__ADE28840

SEQ ID NO: 4480 - protein, 566 aa, Artificial Sequence; identical to SEQ ID NO: 2849
  hemagglutinin__InfluenzaA__ADE28850

SEQ ID NO: 4481 - protein, 566 aa, Artificial Sequence; identical to SEQ ID NO: 2849
  hemagglutinin__InfluenzaA__ADE28881

SEQ ID NO: 4482 - protein, 566 aa, Artificial Sequence; identical to SEQ ID NO: 2849
  hemagglutinin__InfluenzaA__ADE28891

SEQ ID NO: 4483 - protein, 566 aa, Artificial Sequence; identical to SEQ ID NO: 4352
  hemagglutinin__InfluenzaA__ADE28911

SEQ ID NO: 4484 - protein, 566 aa, Artificial Sequence; identical to SEQ ID NO: 3833
  hemagglutinin__InfluenzaA__ADE28921

SEQ ID NO: 4485 - protein, 566 aa, Artificial Sequence; identical to SEQ ID NO: 3833
  hemagglutinin__InfluenzaA__ADE28931

SEQ ID NO: 4486 - protein, 566 aa, Artificial Sequence; identical to SEQ ID NO: 3022
  hemagglutinin__InfluenzaA__ADE28951

SEQ ID NO: 4487 - protein, 566 aa, Artificial Sequence
  hemagglutinin__InfluenzaA__ADE28961
MKAILVVLLYTFATANADTLCIGYHANNSTDTVDTVLEKNVTVTHSVNLLEDKHNGKLCKLRGVAPLHLGKCNVAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4488 - protein, 566 aa, Artificial Sequence; identical to SEQ ID NO: 4373
  hemagglutinin__InfluenzaA__ADE28971

SEQ ID NO: 4489 - protein, 566 aa, Artificial Sequence
  hemagglutinin__InfluenzaA__ADE28981
MKAILVVLLYTFATANADTLCIGYHANNSTETVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4490 - protein, 566 aa, Artificial Sequence; identical to SEQ ID NO: 3833
  hemagglutinin__InfluenzaA__ADE28991

SEQ ID NO: 4491 - protein, 566 aa, Artificial Sequence
  hemagglutinin__InfluenzaA__ADE29001
MKAILVVLLYTFATANADTLCIGYHANNSTDTVDTVLERNVTVTHSVNLLEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4492 - protein, 566 aa, Artificial Sequence; identical to SEQ ID NO: 2911
  hemagglutinin__InfluenzaA__ADE29011

SEQ ID NO: 4493 - protein, 566 aa, Artificial Sequence
  hemagglutinin__InfluenzaA__ADE29021
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSGSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVSVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4494 - protein, 566 aa, Artificial Sequence; identical to SEQ ID NO: 4318
  hemagglutinin__InfluenzaA__ADE29031

SEQ ID NO: 4495 - protein, 566 aa, Artificial Sequence
  hemagglutinin__InfluenzaA__ADE29041
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4496 - protein, 566 aa, Artificial Sequence; identical to SEQ ID NO: 4318
  hemagglutinin__InfluenzaA__ADE29051

SEQ ID NO: 4497 - protein, 566 aa, Artificial Sequence
  hemagglutinin__InfluenzaA__ADE29085
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAEAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4498 - protein, 566 aa, Artificial Sequence
  hemagglutinin__InfluenzaA__ADE29095
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKTFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4499 - protein, 566 aa, Artificial Sequence; identical to SEQ ID NO: 3588
  hemagglutinin__InfluenzaA__ADE34191

SEQ ID NO: 4500 - protein, 566 aa, Artificial Sequence; identical to SEQ ID NO: 3588
  hemagglutinin__InfluenzaA__ADE34202

SEQ ID NO: 4501 - protein, 566 aa, Artificial Sequence
  hemagglutinin__InfluenzaA__ADE34213
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERRKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4502 - protein, 566 aa, Artificial Sequence; identical to SEQ ID NO: 3588
  hemagglutinin__InfluenzaA__ADE34224

SEQ ID NO: 4503 - protein, 566 aa, Artificial Sequence
  hemagglutinin__InfluenzaA__ADE34235
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQDGTSSACIRRSKNSFFSRLNWLTHLNFKYPALNVTMPNNEQFDKLYIWGVHHPGTDKDQIFLYAQASGRTTVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4504 - protein, 566 aa, Artificial Sequence; identical to SEQ ID NO: 3588
  hemagglutinin__InfluenzaA__ADE34246

SEQ ID NO: 4505 - protein, 566 aa, Artificial Sequence; identical to SEQ ID NO: 3613
  hemagglutinin__InfluenzaA__ADE34257

SEQ ID NO: 4506 - protein, 566 aa, Artificial Sequence
  hemagglutinin__InfluenzaA__ADE34268
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYEVPDYASLRSLVASSGTLEFNNESFNWTGVTQDGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4507 - protein, 566 aa, Artificial Sequence
  hemagglutinin__InfluenzaA__ADE45499
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFKRFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4508 - protein, 566 aa, Artificial Sequence; identical to SEQ ID NO: 3467
  hemagglutinin__InfluenzaA__ADE45501

SEQ ID NO: 4509 - protein, 566 aa, Artificial Sequence
  hemagglutinin__InfluenzaA__ADE45503
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 4510 - protein, 566 aa, Artificial Sequence; identical to SEQ ID NO: 2669
  hemagglutinin__InfluenzaA__ADE45505

SEQ ID NO: 4511 - protein, 566 aa, Artificial Sequence; identical to SEQ ID NO: 3022
  hemagglutinin__InfluenzaA__ADE45507

SEQ ID NO: 4512 - protein, 566 aa, Artificial Sequence; identical to SEQ ID NO: 3022
  hemagglutinin__InfluenzaA__ADE45509

SEQ ID NO: 4513 - protein, 566 aa, Artificial Sequence; identical to SEQ ID NO: 3467
  hemagglutinin__InfluenzaA__ADE45511

SEQ ID NO: 4514 - protein, 566 aa, Artificial Sequence
  hemagglutinin__InfluenzaA__ADE45513
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYAFVGTSRYSKKFKPEIAIRPKVRDQEGRINYYWTLVEPGDKIIFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4515 - protein, 566 aa, Artificial Sequence
  hemagglutinin__InfluenzaA__ADE75388
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSENGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4516 - protein, 566 aa, Artificial Sequence; identical to SEQ ID NO: 2669
  hemagglutinin__InfluenzaA__ADE75390

SEQ ID NO: 4517 - protein, 566 aa, Artificial Sequence; identical to SEQ ID NO: 2669
  hemagglutinin__InfluenzaA__ADF10067

SEQ ID NO: 4518 - protein, 566 aa, Artificial Sequence; identical to SEQ ID NO: 2669
  hemagglutinin__InfluenzaA__ADF10077

SEQ ID NO: 4519 - protein, 566 aa, Artificial Sequence
  hemagglutinin__InfluenzaA__ADF10087
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMKRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4520 - protein, 566 aa, Artificial Sequence
  hemagglutinin__InfluenzaA__ADF10097
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 4521 - protein, 566 aa, Artificial Sequence
  hemagglutinin__InfluenzaA__ADF10107
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGSSKYSKKFKPEIAIRPKVRDQEGRMNYYWTLVEPGDKITFEATGNLVVPRYAFAMERNAGSGIIISDTPAHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 4522 - protein, 566 aa, Artificial Sequence; identical to SEQ ID NO: 2669
  hemagglutinin__InfluenzaA__ADF10117

SEQ ID NO: 4523 - protein, 566 aa, Artificial Sequence; identical to SEQ ID NO: 4373
  hemagglutinin__InfluenzaA__ADF10127

SEQ ID NO: 4524 - protein, 566 aa, Artificial Sequence; identical to SEQ ID NO: 2669
  hemagglutinin__InfluenzaA__ADF10137

SEQ ID NO: 4525 - protein, 566 aa, Artificial Sequence
  hemagglutinin__InfluenzaA__ADF10154
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYERVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4526 - protein, 566 aa, Artificial Sequence
  hemagglutinin__InfluenzaA__ADF10174
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYERVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4527 - protein, 566 aa, Artificial Sequence; identical to SEQ ID NO: 4526
  hemagglutinin__InfluenzaA__ADF10190

SEQ ID NO: 4528 - protein, 566 aa, Artificial Sequence; identical to SEQ ID NO: 4373
  hemagglutinin__InfluenzaA__ADF10237

SEQ ID NO: 4529 - protein, 566 aa, Artificial Sequence; identical to SEQ ID NO: 4526
  hemagglutinin__InfluenzaA__ADF10262

SEQ ID NO: 4530 - protein, 566 aa, Artificial Sequence
  hemagglutinin__InfluenzaA__ADF10288
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYERVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRVCI

SEQ ID NO: 4531 - protein, 566 aa, Artificial Sequence; identical to SEQ ID NO: 4373
  hemagglutinin__InfluenzaA__ADF10302

SEQ ID NO: 4532 - protein, 566 aa, Artificial Sequence; identical to SEQ ID NO: 4373
  hemagglutinin__InfluenzaA__ADF10335

SEQ ID NO: 4533 - protein, 566 aa, Artificial Sequence; identical to SEQ ID NO: 4373
  hemagglutinin__InfluenzaA__ADF10359

SEQ ID NO: 4534 - protein, 566 aa, Artificial Sequence; identical to SEQ ID NO: 4526
  hemagglutinin__InfluenzaA__ADF10369

SEQ ID NO: 4535 - protein, 566 aa, Artificial Sequence; identical to SEQ ID NO: 4526
  hemagglutinin__InfluenzaA__ADF10390

SEQ ID NO: 4536 - protein, 566 aa, Artificial Sequence; identical to SEQ ID NO: 4373
  hemagglutinin__InfluenzaA__ADF10528

SEQ ID NO: 4537 - protein, 566 aa, Artificial Sequence; identical to SEQ ID NO: 4526
  hemagglutinin__InfluenzaA__ADF10598

SEQ ID NO: 4538 - protein, 566 aa, Artificial Sequence; identical to SEQ ID NO: 4526
  hemagglutinin__InfluenzaA__ADF10670

SEQ ID NO: 4539 - protein, 566 aa, Artificial Sequence; identical to SEQ ID NO: 4526
  hemagglutinin__InfluenzaA__ADF10724

SEQ ID NO: 4540 - protein, 566 aa, Artificial Sequence; identical to SEQ ID NO: 4373
  hemagglutinin__InfluenzaA__ADF10757

SEQ ID NO: 4541 - protein, 566 aa, Artificial Sequence
  hemagglutinin__InfluenzaA__ADF10828
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4542 - protein, 566 aa, Artificial Sequence; identical to SEQ ID NO: 2669
  hemagglutinin__InfluenzaA__ADF10874

SEQ ID NO: 4543 - protein, 566 aa, Artificial Sequence; identical to SEQ ID NO: 3292
  hemagglutinin__InfluenzaA__ADF10929

SEQ ID NO: 4544 - protein, 566 aa, Artificial Sequence; identical to SEQ ID NO: 3292
  hemagglutinin__InfluenzaA__ADF10996

SEQ ID NO: 4545 - protein, 566 aa, Artificial Sequence; identical to SEQ ID NO: 2669
  hemagglutinin__InfluenzaA__ADF27367

SEQ ID NO: 4546 - protein, 566 aa, Artificial Sequence; identical to SEQ ID NO: 2669
  hemagglutinin__InfluenzaA__ADF27369

SEQ ID NO: 4547 - protein, 566 aa, Artificial Sequence
  hemagglutinin__InfluenzaA__ADF27370
MKAILVILLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVLVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4548 - protein, 566 aa, Artificial Sequence; identical to SEQ ID NO: 3841
  hemagglutinin__InfluenzaA__ADF27371

SEQ ID NO: 4549 - protein, 566 aa, Artificial Sequence
  hemagglutinin__InfluenzaA__ADF27372
MKAILVVLLYTFATANADTLCIGYHTNNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4550 - protein, 566 aa, Artificial Sequence
  hemagglutinin__InfluenzaA__ADF27373
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELIEQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQTRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4551 - protein, 566 aa, Artificial Sequence; identical to SEQ ID NO: 2911
  hemagglutinin__InfluenzaA__ADF27374

SEQ ID NO: 4552 - protein, 566 aa, Artificial Sequence
  hemagglutinin__InfluenzaA__ADF27375
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADQKSTQNAIDEITNKINSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4553 - protein, 566 aa, Artificial Sequence
  hemagglutinin__InfluenzaA__ADF27376
MKAILVVLLYTFVTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIEIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4554 - protein, 566 aa, Artificial Sequence
  hemagglutinin__InfluenzaA__ADF27378
MKAILVVLLYTFVTANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4555 - protein, 566 aa, Artificial Sequence
  hemagglutinin__InfluenzaA__ADF27389
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIITSDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4556 - protein, 566 aa, Artificial Sequence
  hemagglutinin__InfluenzaA__ADF27399
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4557 - protein, 566 aa, Artificial Sequence; identical to SEQ ID NO: 3833
  hemagglutinin__InfluenzaA__ADF27409

SEQ ID NO: 4558 - protein, 566 aa, Artificial Sequence; identical to SEQ ID NO: 4541
  hemagglutinin__InfluenzaA__ADF27419

SEQ ID NO: 4559 - protein, 566 aa, Artificial Sequence
  hemagglutinin__InfluenzaA__ADF27429
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKFYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMKSVKNGTYDYPKYSEEAKLNREEIDGVKLESTRIYQILAIYSTVASSLVLVVSLGAISFWMCSNGSLQCRICI

SEQ ID NO: 4560 - protein, 566 aa, Artificial Sequence; identical to SEQ ID NO: 2669
  hemagglutinin__InfluenzaA__ADF27439

SEQ ID NO: 4561 - protein, 566 aa, Artificial Sequence
  hemagglutinin__InfluenzaA__ADF27449
MKAILVVLLYTFATVNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4562 - protein, 566 aa, Artificial Sequence; identical to SEQ ID NO: 3829
  hemagglutinin__InfluenzaA__ADF27459

SEQ ID NO: 4563 - protein, 566 aa, Artificial Sequence; identical to SEQ ID NO: 2669
  hemagglutinin__InfluenzaA__ADF27469

SEQ ID NO: 4564 - protein, 566 aa, Artificial Sequence
  hemagglutinin__InfluenzaA__ADF27479
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIHSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4565 - protein, 566 aa, Artificial Sequence
  hemagglutinin__InfluenzaA__ADF27489
MKAILVVLLYTFATANADTLCIGYHANNSTDTVDTVLEKNVTVTHSVNLLEYKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4566 - protein, 566 aa, Artificial Sequence; identical to SEQ ID NO: 3833
  hemagglutinin__InfluenzaA__ADF27499

SEQ ID NO: 4567 - protein, 566 aa, Artificial Sequence; identical to SEQ ID NO: 2669
  hemagglutinin__InfluenzaA__ADF27509

SEQ ID NO: 4568 - protein, 566 aa, Artificial Sequence; identical to SEQ ID NO: 4266
  hemagglutinin__InfluenzaA__ADF27529

SEQ ID NO: 4569 - protein, 566 aa, Artificial Sequence; identical to SEQ ID NO: 3841
  hemagglutinin__InfluenzaA__ADF27539

SEQ ID NO: 4570 - protein, 566 aa, Artificial Sequence; identical to SEQ ID NO: 3841
  hemagglutinin__InfluenzaA__ADF27549

SEQ ID NO: 4571 - protein, 566 aa, Artificial Sequence; identical to SEQ ID NO: 2669
  hemagglutinin__InfluenzaA__ADF27559

SEQ ID NO: 4572 - protein, 566 aa, Artificial Sequence
  hemagglutinin__InfluenzaA__ADF27569
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRVNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4573 - protein, 566 aa, Artificial Sequence; identical to SEQ ID NO: 3841
  hemagglutinin__InfluenzaA__ADF27579

SEQ ID NO: 4574 - protein, 566 aa, Artificial Sequence
  hemagglutinin__InfluenzaA__ADF27589
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4575 - protein, 566 aa, Artificial Sequence
  hemagglutinin__InfluenzaA__ADF27599
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKSNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4576 - protein, 566 aa, Artificial Sequence
  hemagglutinin__InfluenzaA__ADF27609
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4577 - protein, 566 aa, Artificial Sequence
  hemagglutinin__InfluenzaA__ADF27619
MKAILVVLLYTFATANADTLCIGYHANNSTDTVDTVLEKNVTVTHSVNLLEDKHNGKLCKLRGVVPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4578 - protein, 566 aa, Artificial Sequence; identical to SEQ ID NO: 3841
  hemagglutinin__InfluenzaA__ADF27629

SEQ ID NO: 4579 - protein, 566 aa, Artificial Sequence
  hemagglutinin__InfluenzaA__ADF27649
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQPRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4580 - protein, 566 aa, Artificial Sequence; identical to SEQ ID NO: 3841
  hemagglutinin__InfluenzaA__ADF27659

SEQ ID NO: 4581 - protein, 566 aa, Artificial Sequence; identical to SEQ ID NO: 4318
  hemagglutinin__InfluenzaA__ADF27669

SEQ ID NO: 4582 - protein, 566 aa, Artificial Sequence; identical to SEQ ID NO: 3770
  hemagglutinin__InfluenzaA__ADF27679

SEQ ID NO: 4583 - protein, 566 aa, Artificial Sequence; identical to SEQ ID NO: 4379
  hemagglutinin__InfluenzaA__ADF27689

SEQ ID NO: 4584 - protein, 566 aa, Artificial Sequence
  hemagglutinin__InfluenzaA__ADF27699
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4585 - protein, 566 aa, Artificial Sequence
  hemagglutinin__InfluenzaA__ADF27709
MKAILVVLLYTFATANADTLCIGYHANNSTDTVDTVLEKNVTVTHSVNLLEDKHNGKLCKLRGVAPLHLGKCNIAGWILGNPECESLSTASSWSYIVEISSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4586 - protein, 566 aa, Artificial Sequence; identical to SEQ ID NO: 3833
  hemagglutinin__InfluenzaA__ADF27785

SEQ ID NO: 4587 - protein, 566 aa, Artificial Sequence
  hemagglutinin__InfluenzaA__ADF27795
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4588 - protein, 566 aa, Artificial Sequence; identical to SEQ ID NO: 3841
  hemagglutinin__InfluenzaA__ADF27805

SEQ ID NO: 4589 - protein, 566 aa, Artificial Sequence
  hemagglutinin__InfluenzaA__ADF27815
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHDGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4590 - protein, 566 aa, Artificial Sequence
  hemagglutinin__InfluenzaA__ADF27825
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDSEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4591 - protein, 566 aa, Artificial Sequence
  hemagglutinin__InfluenzaA__ADF27845
MKAILVVLLYTFATANADTLCIGYHANNSTDTVDTVLEKNVTVTHSANLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTNADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4592 - protein, 566 aa, Artificial Sequence; identical to SEQ ID NO: 3833
  hemagglutinin__InfluenzaA__ADF27855

SEQ ID NO: 4593 - protein, 566 aa, Artificial Sequence; identical to SEQ ID NO: 3833
  hemagglutinin__InfluenzaA__ADF27865

SEQ ID NO: 4594 - protein, 566 aa, Artificial Sequence; identical to SEQ ID NO: 3833
  hemagglutinin__InfluenzaA__ADF27875

SEQ ID NO: 4595 - protein, 566 aa, Artificial Sequence; identical to SEQ ID NO: 3833
  hemagglutinin__InfluenzaA__ADF27885

SEQ ID NO: 4596 - protein, 566 aa, Artificial Sequence; identical to SEQ ID NO: 2669
  hemagglutinin__InfluenzaA__ADF27895

SEQ ID NO: 4597 - protein, 566 aa, Artificial Sequence
  hemagglutinin__InfluenzaA__ADF27915
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSASADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4598 - protein, 566 aa, Artificial Sequence
  hemagglutinin__InfluenzaA__ADF27925
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSNSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4599 - protein, 566 aa, Artificial Sequence
  hemagglutinin__InfluenzaA__ADF27935
MKAILVVLLYTFATANADTLCIGYHANNSTDTVDTVLEKNVTVTHSVNLLEDKHNGKLCKLRGVAPLHLGKCNIAGWILGNPKCESLSTESSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4600 - protein, 566 aa, Artificial Sequence
  hemagglutinin__InfluenzaA__ADF27955
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSNSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4601 - protein, 566 aa, Artificial Sequence
  hemagglutinin__InfluenzaA__ADF27965
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKKVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVNDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4602 - protein, 566 aa, Artificial Sequence; identical to SEQ ID NO: 3833
  hemagglutinin__InfluenzaA__ADF27975

SEQ ID NO: 4603 - protein, 566 aa, Artificial Sequence; identical to SEQ ID NO: 3841
  hemagglutinin__InfluenzaA__ADF27985

SEQ ID NO: 4604 - protein, 566 aa, Artificial Sequence
  hemagglutinin__InfluenzaA__ADF27995
MKAILVVLLYTFATANADTLCIGYHANNSTDTVDTVLEKNVTVTHSANLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTNADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4605 - protein, 566 aa, Artificial Sequence; identical to SEQ ID NO: 4221
  hemagglutinin__InfluenzaA__ADF28005

SEQ ID NO: 4606 - protein, 566 aa, Artificial Sequence; identical to SEQ ID NO: 4221
  hemagglutinin__InfluenzaA__ADF28015

SEQ ID NO: 4607 - protein, 566 aa, Artificial Sequence; identical to SEQ ID NO: 3833
  hemagglutinin__InfluenzaA__ADF28025

SEQ ID NO: 4608 - protein, 566 aa, Artificial Sequence; identical to SEQ ID NO: 3833
  hemagglutinin__InfluenzaA__ADF28045

SEQ ID NO: 4609 - protein, 566 aa, Artificial Sequence
  hemagglutinin__InfluenzaA__ADF28055
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNYDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4610 - protein, 566 aa, Artificial Sequence; identical to SEQ ID NO: 3833
  hemagglutinin__InfluenzaA__ADF28065

SEQ ID NO: 4611 - protein, 566 aa, Artificial Sequence; identical to SEQ ID NO: 2851
  hemagglutinin__InfluenzaA__ADF28075

SEQ ID NO: 4612 - protein, 566 aa, Artificial Sequence; identical to SEQ ID NO: 3770
  hemagglutinin__InfluenzaA__ADF28085

SEQ ID NO: 4613 - protein, 566 aa, Artificial Sequence; identical to SEQ ID NO: 2849
  hemagglutinin__InfluenzaA__ADF28107

SEQ ID NO: 4614 - protein, 566 aa, Artificial Sequence; identical to SEQ ID NO: 4221
  hemagglutinin__InfluenzaA__ADF28117

SEQ ID NO: 4615 - protein, 566 aa, Artificial Sequence
  hemagglutinin__InfluenzaA__ADF29918
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSRSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4616 - protein, 566 aa, Artificial Sequence
  hemagglutinin__InfluenzaA__ADF42689
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLAVSLGAIGFWMCSNGSLQCRICI

SEQ ID NO: 4617 - protein, 566 aa, Artificial Sequence
  hemagglutinin__InfluenzaA__ADF42699
MKAILVVLLYTFATANADTLCIGYHANNSTDTVDTVLEKNVTVTHSVNLLEDKHNGTLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4618 - protein, 566 aa, Artificial Sequence; identical to SEQ ID NO: 3833
  hemagglutinin__InfluenzaA__ADF42709

SEQ ID NO: 4619 - protein, 566 aa, Artificial Sequence; identical to SEQ ID NO: 3833
  hemagglutinin__InfluenzaA__ADF42719

SEQ ID NO: 4620 - protein, 566 aa, Artificial Sequence; identical to SEQ ID NO: 3833
  hemagglutinin__InfluenzaA__ADF42729

SEQ ID NO: 4621 - protein, 566 aa, Artificial Sequence; identical to SEQ ID NO: 3833
  hemagglutinin__InfluenzaA__ADF42739

SEQ ID NO: 4622 - protein, 566 aa, Artificial Sequence
  hemagglutinin__InfluenzaA__ADF58349
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4623 - protein, 566 aa, Artificial Sequence; identical to SEQ ID NO: 4266
  hemagglutinin__InfluenzaA__ADF58351

SEQ ID NO: 4624 - protein, 566 aa, Artificial Sequence
  hemagglutinin__InfluenzaA__ADF80454
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSIIEKMNTQFTAVGKEFNHLEKRIENLNKKVDDGFLDIWTYNAELLVLLENERTLDYHDSNVKNLYEKVRSQLKNNAKEIGNGCFEFYHKCDDTCMESVKNGTYDYPKYSEEAKLNREEIDGVKLESTRIYQILAIYSTVASSLVLVVSLGAISFWMCSNGSLQCRICI

SEQ ID NO: 4625 - protein, 566 aa, Artificial Sequence
  hemagglutinin__InfluenzaA__ADF80462
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKISSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4626 - protein, 566 aa, Artificial Sequence; identical to SEQ ID NO: 2669
  hemagglutinin__InfluenzaA__ADF80470

SEQ ID NO: 4627 - protein, 566 aa, Artificial Sequence
  hemagglutinin__InfluenzaA__ADF80478
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLMVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4628 - protein, 566 aa, Artificial Sequence
  hemagglutinin__InfluenzaA__ADF80494
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4629 - protein, 566 aa, Artificial Sequence; identical to SEQ ID NO: 4628
  hemagglutinin__InfluenzaA__ADF80498

SEQ ID NO: 4630 - protein, 566 aa, Artificial Sequence; identical to SEQ ID NO: 3293
  hemagglutinin__InfluenzaA__ADF80502

SEQ ID NO: 4631 - protein, 566 aa, Artificial Sequence
  hemagglutinin__InfluenzaA__ADF80506
MKAILVVLLYTFATANADTLCIGYHANNSTDTVDTVLERNVTVTHSVNLLEDKHNGKLCKLRGVAPLHLGKCSIAGWILGNPECESLSTASSWSYIVETSSSDNGTCYPGDFIDYEELREQLSSVSSFERFEIFPKTSSWPNHDPNKGVTAACPHAGAKSFYKNLIWLVKKENSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4632 - protein, 566 aa, Artificial Sequence
  hemagglutinin__InfluenzaA__ADF83741
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSVMRSDAPIGKCNSDCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4633 - protein, 566 aa, Artificial Sequence; identical to SEQ ID NO: 3411
  hemagglutinin__InfluenzaA__ADF83752

SEQ ID NO: 4634 - protein, 566 aa, Artificial Sequence; identical to SEQ ID NO: 4221
  hemagglutinin__InfluenzaA__ADF83763

SEQ ID NO: 4635 - protein, 566 aa, Artificial Sequence; identical to SEQ ID NO: 4221
  hemagglutinin__InfluenzaA__ADF83773

SEQ ID NO: 4636 - protein, 566 aa, Artificial Sequence
  hemagglutinin__InfluenzaA__ADF83783
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPTTIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4637 - protein, 566 aa, Artificial Sequence; identical to SEQ ID NO: 4296
  hemagglutinin__InfluenzaA__ADF83793

SEQ ID NO: 4638 - protein, 566 aa, Artificial Sequence
  hemagglutinin__InfluenzaA__ADF83803
MKAILVVLLYTFATANADTLCIGYHANNSTDTVDTVLEKNVTVTHSVNLLEDKHNGKLCKLRGVAPLHLGKCNIAGWILGNPECETLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKETGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4639 - protein, 566 aa, Artificial Sequence
  hemagglutinin__InfluenzaA__ADF83813
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4640 - protein, 566 aa, Artificial Sequence
  hemagglutinin__InfluenzaA__ADF83823
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4641 - protein, 566 aa, Artificial Sequence; identical to SEQ ID NO: 4221
  hemagglutinin__InfluenzaA__ADF83833

SEQ ID NO: 4642 - protein, 566 aa, Artificial Sequence; identical to SEQ ID NO: 4221
  hemagglutinin__InfluenzaA__ADF83843

SEQ ID NO: 4643 - protein, 566 aa, Artificial Sequence; identical to SEQ ID NO: 4221
  hemagglutinin__InfluenzaA__ADF83853

SEQ ID NO: 4644 - protein, 566 aa, Artificial Sequence
  hemagglutinin__InfluenzaA__ADF83873
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4645 - protein, 566 aa, Artificial Sequence; identical to SEQ ID NO: 3833
  hemagglutinin__InfluenzaA__ADF83885

SEQ ID NO: 4646 - protein, 566 aa, Artificial Sequence
  hemagglutinin__InfluenzaA__ADF83895
MKAILVVLLYTFATVNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKIRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4647 - protein, 566 aa, Artificial Sequence; identical to SEQ ID NO: 4221
  hemagglutinin__InfluenzaA__ADF83915

SEQ ID NO: 4648 - protein, 566 aa, Artificial Sequence
  hemagglutinin__InfluenzaA__ADF84441
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPSHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNIQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4649 - protein, 566 aa, Artificial Sequence; identical to SEQ ID NO: 3833
  hemagglutinin__InfluenzaA__ADF84459

SEQ ID NO: 4650 - protein, 566 aa, Artificial Sequence; identical to SEQ ID NO: 4221
  hemagglutinin__InfluenzaA__ADF84469

SEQ ID NO: 4651 - protein, 566 aa, Artificial Sequence; identical to SEQ ID NO: 4282
  hemagglutinin__InfluenzaA__ADF84479

SEQ ID NO: 4652 - protein, 566 aa, Artificial Sequence; identical to SEQ ID NO: 4221
  hemagglutinin__InfluenzaA__ADF84489

SEQ ID NO: 4653 - protein, 566 aa, Artificial Sequence; identical to SEQ ID NO: 4221
  hemagglutinin__InfluenzaA__ADF85017

SEQ ID NO: 4654 - protein, 566 aa, Artificial Sequence; identical to SEQ ID NO: 4221
  hemagglutinin__InfluenzaA__ADF87152

SEQ ID NO: 4655 - protein, 566 aa, Artificial Sequence
  hemagglutinin__InfluenzaA__ADF87162
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSKYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4656 - protein, 566 aa, Artificial Sequence; identical to SEQ ID NO: 4221
  hemagglutinin__InfluenzaA__ADF87172

SEQ ID NO: 4657 - protein, 566 aa, Artificial Sequence
  hemagglutinin__InfluenzaA__ADF87182
MNAILVVLLYTFATANADTLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDAPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKINSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4658 - protein, 566 aa, Artificial Sequence; identical to SEQ ID NO: 4221
  hemagglutinin__InfluenzaA__ADF87192

SEQ ID NO: 4659 - protein, 566 aa, Artificial Sequence
  hemagglutinin__InfluenzaA__ADF87202
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGFAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4660 - protein, 566 aa, Artificial Sequence; identical to SEQ ID NO: 4221
  hemagglutinin__InfluenzaA__ADF87212

SEQ ID NO: 4661 - protein, 566 aa, Artificial Sequence; identical to SEQ ID NO: 4384
  hemagglutinin__InfluenzaA__ADF87232

SEQ ID NO: 4662 - protein, 566 aa, Artificial Sequence; identical to SEQ ID NO: 4221
  hemagglutinin__InfluenzaA__ADF87242

SEQ ID NO: 4663 - protein, 566 aa, Artificial Sequence
  hemagglutinin__InfluenzaA__ADF87252
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGKSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4664 - protein, 566 aa, Artificial Sequence; identical to SEQ ID NO: 4221
  hemagglutinin__InfluenzaA__ADF87262

SEQ ID NO: 4665 - protein, 566 aa, Artificial Sequence; identical to SEQ ID NO: 3833
  hemagglutinin__InfluenzaA__ADF87272

SEQ ID NO: 4666 - protein, 566 aa, Artificial Sequence; identical to SEQ ID NO: 3833
  hemagglutinin__InfluenzaA__ADF87282

SEQ ID NO: 4667 - protein, 566 aa, Artificial Sequence
  hemagglutinin__InfluenzaA__ADF87292
MKAILVVLLYTFATANADTLCIGYHANNSTDTVDTVLKKNVTVTHSVNLLEDKHNGKLCKLRGVAPLHLGKCNIAGWILGNPECESLSTAGSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNMCMESVKNGTYDYPKYSEEAKLNREEIDGVKLESTRIYQILAIYSTVASSLVLVVSLGAISFWMCSNGSLQCRICI

SEQ ID NO: 4668 - protein, 566 aa, Artificial Sequence; identical to SEQ ID NO: 3833
  hemagglutinin__InfluenzaA__ADF87302

SEQ ID NO: 4669 - protein, 566 aa, Artificial Sequence
  hemagglutinin__InfluenzaA__ADF87331
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFINYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4670 - protein, 566 aa, Artificial Sequence; identical to SEQ ID NO: 2669
  hemagglutinin__InfluenzaA__ADF87341

SEQ ID NO: 4671 - protein, 566 aa, Artificial Sequence
  hemagglutinin__InfluenzaA__ADF87351
MKAILVVLLYTFATANADTLCIGYHANNSTDTVDTVLEKNVTVTHSVNLLEDKHNGKLCKLRGVAPLHLGKCNIAGWILGNPECDSLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4672 - protein, 566 aa, Artificial Sequence; identical to SEQ ID NO: 4296
  hemagglutinin__InfluenzaA__ADF87361

SEQ ID NO: 4673 - protein, 566 aa, Artificial Sequence; identical to SEQ ID NO: 3833
  hemagglutinin__InfluenzaA__ADF87371

SEQ ID NO: 4674 - protein, 566 aa, Artificial Sequence
  hemagglutinin__InfluenzaA__ADG08115
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4675 - protein, 566 aa, Artificial Sequence; identical to SEQ ID NO: 3411
  hemagglutinin__InfluenzaA__ADG21004

SEQ ID NO: 4676 - protein, 566 aa, Artificial Sequence; identical to SEQ ID NO: 3411
  hemagglutinin__InfluenzaA__ADG21006

SEQ ID NO: 4677 - protein, 566 aa, Artificial Sequence
  hemagglutinin__InfluenzaA__ADG21008
MKTIIALSYILCLVFAQKIPGNDNSTATLCLGHHAVPNGTIVKTITNDQIEVTNATELVQSSSTGEICDSPHQILDGENCTLIDALLGDPQCDGFQNKKWDLFVERSKSYSNCYPYDVPDYASLRSLVASSGTLEFNNESFNWTGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4678 - protein, 566 aa, Artificial Sequence
  hemagglutinin__InfluenzaA__ADG21009
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4679 - protein, 566 aa, Artificial Sequence; identical to SEQ ID NO: 3411
  hemagglutinin__InfluenzaA__ADG21010

SEQ ID NO: 4680 - protein, 566 aa, Artificial Sequence
  hemagglutinin__InfluenzaA__ADG21011
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4681 - protein, 566 aa, Artificial Sequence; identical to SEQ ID NO: 3411
  hemagglutinin__InfluenzaA__ADG21012

SEQ ID NO: 4682 - protein, 566 aa, Artificial Sequence; identical to SEQ ID NO: 3411
  hemagglutinin__InfluenzaA__ADG21013

SEQ ID NO: 4683 - protein, 566 aa, Artificial Sequence
  hemagglutinin__InfluenzaA__ADG21014
MKTIIALSYILCLVFAQKIPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4684 - protein, 566 aa, Artificial Sequence
  hemagglutinin__InfluenzaA__ADG21017
MKTIIALSYILYLVFAQKLPGNDNSTATLCLGHHAVPNGTIVKTITNDQIEVTNATELVQSSSTGEICDSPHQILDGENCTLIDALLGDPQCDGFQNKKWDLFIERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4685 - protein, 566 aa, Artificial Sequence
  hemagglutinin__InfluenzaA__ADG21018
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSNFKYPALNVTMPNNEQFDKLYIWGVHHPGTDKDQIFLYAQASGRITVSTKRSQQAVIPNIGSRHRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4686 - protein, 566 aa, Artificial Sequence
  hemagglutinin__InfluenzaA__ADG21019
MKTIIALSYILCLVFAQKLPGNDNSTATLCLGHHAVPNGTIVKTITNDQIEVTNATELVQSSSTGEICDSPHQILDGKNCTLIDTLLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGKIIVSTKRSQQTVIPNIGSRPRVRNIPSIISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDIGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4687 - protein, 566 aa, Artificial Sequence
  hemagglutinin__InfluenzaA__ADG21020
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQSGTSSACIRRSKNSFFSRLNWLTHLNFKYPALNVTMPNNEQFDKLYIWGVHHPGTDKDQIFLYAQASGRIIVSTKRSQQTVTPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4688 - protein, 566 aa, Artificial Sequence; identical to SEQ ID NO: 2434
  hemagglutinin__InfluenzaA__ADG21022

SEQ ID NO: 4689 - protein, 566 aa, Artificial Sequence; identical to SEQ ID NO: 2434
  hemagglutinin__InfluenzaA__ADG21023

SEQ ID NO: 4690 - protein, 566 aa, Artificial Sequence
  hemagglutinin__InfluenzaA__ADG21024
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGALEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 4691 - protein, 566 aa, Artificial Sequence
  hemagglutinin__InfluenzaA__ADG21026
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRLRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 4692 - protein, 566 aa, Artificial Sequence; identical to SEQ ID NO: 2669
  hemagglutinin__InfluenzaA__ADG21037

SEQ ID NO: 4693 - protein, 566 aa, Artificial Sequence
  hemagglutinin__InfluenzaA__ADG21038
MKAILVVLLYTFATADADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4694 - protein, 566 aa, Artificial Sequence
  hemagglutinin__InfluenzaA__ADG21040
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 4695 - protein, 566 aa, Artificial Sequence
  hemagglutinin__InfluenzaA__ADG21041
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAVSFWMCSNGSLQCRICI

SEQ ID NO: 4696 - protein, 566 aa, Artificial Sequence; identical to SEQ ID NO: 3770
  hemagglutinin__InfluenzaA__ADG21042

SEQ ID NO: 4697 - protein, 566 aa, Artificial Sequence
  hemagglutinin__InfluenzaA__ADG21043
MKAILVVLLYTFTTANADTLCVGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4698 - protein, 566 aa, Artificial Sequence
  hemagglutinin__InfluenzaA__ADG21045
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4699 - protein, 566 aa, Artificial Sequence; identical to SEQ ID NO: 4698
  hemagglutinin__InfluenzaA__ADG21046

SEQ ID NO: 4700 - protein, 566 aa, Artificial Sequence; identical to SEQ ID NO: 3833
  hemagglutinin__InfluenzaA__ADG21048

SEQ ID NO: 4701 - protein, 566 aa, Artificial Sequence
  hemagglutinin__InfluenzaA__ADG21049
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTSKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4702 - protein, 566 aa, Artificial Sequence; identical to SEQ ID NO: 3022
  hemagglutinin__InfluenzaA__ADG21122

SEQ ID NO: 4703 - protein, 566 aa, Artificial Sequence; identical to SEQ ID NO: 3833
  hemagglutinin__InfluenzaA__ADG21123

SEQ ID NO: 4704 - protein, 566 aa, Artificial Sequence; identical to SEQ ID NO: 2669
  hemagglutinin__InfluenzaA__ADG21124

SEQ ID NO: 4705 - protein, 566 aa, Artificial Sequence
  hemagglutinin__InfluenzaA__ADG21125
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFKRFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4706 - protein, 566 aa, Artificial Sequence; identical to SEQ ID NO: 2656
  hemagglutinin__InfluenzaA__ADG21126

SEQ ID NO: 4707 - protein, 566 aa, Artificial Sequence; identical to SEQ ID NO: 2656
  hemagglutinin__InfluenzaA__ADG21127

SEQ ID NO: 4708 - protein, 566 aa, Artificial Sequence; identical to SEQ ID NO: 2656
  hemagglutinin__InfluenzaA__ADG21128

SEQ ID NO: 4709 - protein, 566 aa, Artificial Sequence; identical to SEQ ID NO: 2656
  hemagglutinin__InfluenzaA__ADG21129

SEQ ID NO: 4710 - protein, 566 aa, Artificial Sequence; identical to SEQ ID NO: 2669
  hemagglutinin__InfluenzaA__ADG21130

SEQ ID NO: 4711 - protein, 566 aa, Artificial Sequence; identical to SEQ ID NO: 2656
  hemagglutinin__InfluenzaA__ADG21131

SEQ ID NO: 4712 - protein, 566 aa, Artificial Sequence; identical to SEQ ID NO: 2656
  hemagglutinin__InfluenzaA__ADG21132

SEQ ID NO: 4713 - protein, 566 aa, Artificial Sequence; identical to SEQ ID NO: 2656
  hemagglutinin__InfluenzaA__ADG21133

SEQ ID NO: 4714 - protein, 566 aa, Artificial Sequence; identical to SEQ ID NO: 2656
  hemagglutinin__InfluenzaA__ADG21134

SEQ ID NO: 4715 - protein, 566 aa, Artificial Sequence; identical to SEQ ID NO: 2656
  hemagglutinin__InfluenzaA__ADG21135

SEQ ID NO: 4716 - protein, 566 aa, Artificial Sequence; identical to SEQ ID NO: 2656
  hemagglutinin__InfluenzaA__ADG21136

SEQ ID NO: 4717 - protein, 566 aa, Artificial Sequence; identical to SEQ ID NO: 2656
  hemagglutinin__InfluenzaA__ADG21137

SEQ ID NO: 4718 - protein, 566 aa, Artificial Sequence; identical to SEQ ID NO: 2656
  hemagglutinin__InfluenzaA__ADG21138

SEQ ID NO: 4719 - protein, 566 aa, Artificial Sequence; identical to SEQ ID NO: 2656
  hemagglutinin__InfluenzaA__ADG21139

SEQ ID NO: 4720 - protein, 566 aa, Artificial Sequence
  hemagglutinin__InfluenzaA__ADG21140
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLMLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4721 - protein, 566 aa, Artificial Sequence; identical to SEQ ID NO: 2656
  hemagglutinin__InfluenzaA__ADG21141

SEQ ID NO: 4722 - protein, 566 aa, Artificial Sequence
  hemagglutinin__InfluenzaA__ADG21142
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGEKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4723 - protein, 566 aa, Artificial Sequence; identical to SEQ ID NO: 2656
  hemagglutinin__InfluenzaA__ADG21143

SEQ ID NO: 4724 - protein, 566 aa, Artificial Sequence; identical to SEQ ID NO: 2656
  hemagglutinin__InfluenzaA__ADG21144

SEQ ID NO: 4725 - protein, 566 aa, Artificial Sequence
  hemagglutinin__InfluenzaA__ADG21145
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSISYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4726 - protein, 566 aa, Artificial Sequence; identical to SEQ ID NO: 2656
  hemagglutinin__InfluenzaA__ADG21146

SEQ ID NO: 4727 - protein, 566 aa, Artificial Sequence; identical to SEQ ID NO: 2656
  hemagglutinin__InfluenzaA__ADG21147

SEQ ID NO: 4728 - protein, 566 aa, Artificial Sequence; identical to SEQ ID NO: 2669
  hemagglutinin__InfluenzaA__ADG21148

SEQ ID NO: 4729 - protein, 566 aa, Artificial Sequence; identical to SEQ ID NO: 3770
  hemagglutinin__InfluenzaA__ADG21149

SEQ ID NO: 4730 - protein, 566 aa, Artificial Sequence; identical to SEQ ID NO: 3833
  hemagglutinin__InfluenzaA__ADG21150

SEQ ID NO: 4731 - protein, 566 aa, Artificial Sequence; identical to SEQ ID NO: 2656
  hemagglutinin__InfluenzaA__ADG21151

SEQ ID NO: 4732 - protein, 566 aa, Artificial Sequence; identical to SEQ ID NO: 2656
  hemagglutinin__InfluenzaA__ADG21152

SEQ ID NO: 4733 - protein, 566 aa, Artificial Sequence; identical to SEQ ID NO: 2669
  hemagglutinin__InfluenzaA__ADG21153

SEQ ID NO: 4734 - protein, 566 aa, Artificial Sequence; identical to SEQ ID NO: 2656
  hemagglutinin__InfluenzaA__ADG21154

SEQ ID NO: 4735 - protein, 566 aa, Artificial Sequence; identical to SEQ ID NO: 2656
  hemagglutinin__InfluenzaA__ADG21155

SEQ ID NO: 4736 - protein, 566 aa, Artificial Sequence; identical to SEQ ID NO: 3833
  hemagglutinin__InfluenzaA__ADG21156

SEQ ID NO: 4737 - protein, 566 aa, Artificial Sequence; identical to SEQ ID NO: 3841
  hemagglutinin__InfluenzaA__ADG21158

SEQ ID NO: 4738 - protein, 566 aa, Artificial Sequence
  hemagglutinin__InfluenzaA__ADG21159
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLLVSLGAISFWMCSNGSLQCRICI

SEQ ID NO: 4739 - protein, 566 aa, Artificial Sequence; identical to SEQ ID NO: 3841
  hemagglutinin__InfluenzaA__ADG21160

SEQ ID NO: 4740 - protein, 566 aa, Artificial Sequence
  hemagglutinin__InfluenzaA__ADG21161
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHNSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4741 - protein, 566 aa, Artificial Sequence
  hemagglutinin__InfluenzaA__ADG21163
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDVWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4742 - protein, 566 aa, Artificial Sequence
  hemagglutinin__InfluenzaA__ADG21165
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFKRFEIFPKTNSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4743 - protein, 566 aa, Artificial Sequence; identical to SEQ ID NO: 2656
  hemagglutinin__InfluenzaA__ADG21166

SEQ ID NO: 4744 - protein, 566 aa, Artificial Sequence
  hemagglutinin__InfluenzaA__ADG21168
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKFYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4745 - protein, 566 aa, Artificial Sequence; identical to SEQ ID NO: 4698
  hemagglutinin__InfluenzaA__ADG21169

SEQ ID NO: 4746 - protein, 566 aa, Artificial Sequence; identical to SEQ ID NO: 2656
  hemagglutinin__InfluenzaA__ADG21170

SEQ ID NO: 4747 - protein, 566 aa, Artificial Sequence; identical to SEQ ID NO: 2656
  hemagglutinin__InfluenzaA__ADG21173

SEQ ID NO: 4748 - protein, 566 aa, Artificial Sequence; identical to SEQ ID NO: 2669
  hemagglutinin__InfluenzaA__ADG21174

SEQ ID NO: 4749 - protein, 566 aa, Artificial Sequence; identical to SEQ ID NO: 2669
  hemagglutinin__InfluenzaA__ADG21175

SEQ ID NO: 4750 - protein, 566 aa, Artificial Sequence; identical to SEQ ID NO: 2656
  hemagglutinin__InfluenzaA__ADG21176

SEQ ID NO: 4751 - protein, 566 aa, Artificial Sequence; identical to SEQ ID NO: 2656
  hemagglutinin__InfluenzaA__ADG21177

SEQ ID NO: 4752 - protein, 566 aa, Artificial Sequence; identical to SEQ ID NO: 2656
  hemagglutinin__InfluenzaA__ADG21178

SEQ ID NO: 4753 - protein, 566 aa, Artificial Sequence; identical to SEQ ID NO: 3022
  hemagglutinin__InfluenzaA__ADG21179

SEQ ID NO: 4754 - protein, 566 aa, Artificial Sequence; identical to SEQ ID NO: 2656
  hemagglutinin__InfluenzaA__ADG21180

SEQ ID NO: 4755 - protein, 566 aa, Artificial Sequence; identical to SEQ ID NO: 2656
  hemagglutinin__InfluenzaA__ADG21181

SEQ ID NO: 4756 - protein, 566 aa, Artificial Sequence; identical to SEQ ID NO: 2656
  hemagglutinin__InfluenzaA__ADG21182

SEQ ID NO: 4757 - protein, 566 aa, Artificial Sequence; identical to SEQ ID NO: 2656
  hemagglutinin__InfluenzaA__ADG21183

SEQ ID NO: 4758 - protein, 566 aa, Artificial Sequence; identical to SEQ ID NO: 3833
  hemagglutinin__InfluenzaA__ADG21184

SEQ ID NO: 4759 - protein, 566 aa, Artificial Sequence
  hemagglutinin__InfluenzaA__ADG21185
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVKPGDKITFEATGNLVVPRYAFAMERNAGSGIIISDTPVHDCNTTCQTPKGAINTSLPFQNIHPITIGRCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4760 - protein, 566 aa, Artificial Sequence; identical to SEQ ID NO: 4015
  hemagglutinin__InfluenzaA__ADG21188

SEQ ID NO: 4761 - protein, 568 aa, Artificial Sequence
  hemagglutinin__InfluenzaA__ADG21402
MEKIVLLLAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLILATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4762 - protein, 567 aa, Artificial Sequence
  hemagglutinin__InfluenzaA__ADG21414
MEKIVLLLAIVSIVKSDQICIGYHANNSTEHVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDGAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4763 - protein, 567 aa, Artificial Sequence
  hemagglutinin__InfluenzaA__ADG21416
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTGLYQNPTTYISVGTSTLNQRLVPKIATRSKVNGQSGRMEFFWTILKSNDVINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4764 - protein, 567 aa, Artificial Sequence
  hemagglutinin__InfluenzaA__ADG21420
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4765 - protein, 567 aa, Artificial Sequence
  hemagglutinin__InfluenzaA__ADG21422
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPTNDLCYPGNFNDYEELKHLLSRINHFEKIQIIPKNSWSDHEASGVSSACPYQGRSSFFRNVVWLTKKNNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARSKREEISGVKLESIGTYQILSIYSTVASSLALAIMVAGLFLWMCSNGSLQCRICI

SEQ ID NO: 4766 - protein, 567 aa, Artificial Sequence
  hemagglutinin__InfluenzaA__ADG21425
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHGASGVSSACPYQGRSSFFRNVVWLTKKNNAYPTIKKSYNNTNQEDLLVLWGIHHPNDAEEQTRLYQNPTTYISVGTSTLNQRLVPKIATRSKVNGQSGRMEFFWTILKSNDAINFESNGNFIAPENAYKIVKKGDSTIMKSELEYDNCNTKCQTPIGAINSSMPFHNIHPLTIGECPKYVKSNKLVLATGLRNSPQGEKRRKKRGLFGAIAGFIEGGWQGMVDGWYGYHHSNEQGSGYAADKESTQKAIDGVTNKVNSIIDKMNTQFEAVGREFNALERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 4767 - protein, 567 aa, Artificial Sequence
  hemagglutinin__InfluenzaA__ADG21429
MEKIVLLLAIVSIVKSDQICIGYHANNSTEQVDTIMEKNVTVTHAQDILEKTHNGKLCNLDGVEPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRSKVNGQSGRMEFFWTILKSNDVINFESNGNFIAPENAYKIVKKGDSTIMKSELEYGNCNTKCQTPIGAINSSMPFHNIHPLTIGECPKYVKSDRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLLLWMCSNGSLQCRICI

SEQ ID NO: 4768 - protein, 567 aa, Artificial Sequence
  hemagglutinin__InfluenzaA__ADG21437
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKNSWSDHEASGVSSACPYQGRSSFFRNVVWLTQKNNAYPTIKKSYNNTNQEDLLVLWGIHHPNDAAEQTRLYQNPTTYISVGTSTLNQRLVPKIATRSKVNGQSGRMEFFWTILKSNDVINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4769 - protein, 567 aa, Artificial Sequence
  hemagglutinin__InfluenzaA__ADG21439
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKGSWSDHEASGVSSACPYQGRSSFFRNVVWLTKKNNAYPTIKKSYNNTNQEDLLVLWGIHHPNDAAEQTRLYQNPTTYISVGTSTLNQRLVPQIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4770 - protein, 567 aa, Artificial Sequence
  hemagglutinin__InfluenzaA__ADG21441
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPSNDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDEAEQTSLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4771 - protein, 567 aa, Artificial Sequence
  hemagglutinin__InfluenzaA__ADG21443
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPTNDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4772 - protein, 567 aa, Artificial Sequence
  hemagglutinin__InfluenzaA__ADG21445
MEKIVLLLAIVSIVKSDQICIGYHANNSTEQVDTIMEKNVTVTHAQDILEKTHNGKLCNLDGVKPLILRDCSVAGWLLGNPMCDEFLNVPEWSYIVEKINPSNDLCYPGNFNDYEELKHLLSRINHFEKIQIIPKNSWSDHEASGVSSACPYQGRSSFFRNVVWLTKKNNAYPTIKKSYNNTNQEDLLVLWGIHHPNDEAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 4773 - protein, 566 aa, Artificial Sequence; identical to SEQ ID NO: 2911
  hemagglutinin__InfluenzaA__ADG21912

SEQ ID NO: 4774 - protein, 566 aa, Artificial Sequence; identical to SEQ ID NO: 2669
  hemagglutinin__InfluenzaA__ADG21913

SEQ ID NO: 4775 - protein, 566 aa, Artificial Sequence
  hemagglutinin__InfluenzaA__ADG21914
MKAIIVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4776 - protein, 566 aa, Artificial Sequence
  hemagglutinin__InfluenzaA__ADG21915
MEAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAIERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4777 - protein, 566 aa, Artificial Sequence; identical to SEQ ID NO: 2911
  hemagglutinin__InfluenzaA__ADG21916

SEQ ID NO: 4778 - protein, 566 aa, Artificial Sequence; identical to SEQ ID NO: 2669
  hemagglutinin__InfluenzaA__ADG21917

SEQ ID NO: 4779 - protein, 566 aa, Artificial Sequence; identical to SEQ ID NO: 4169
  hemagglutinin__InfluenzaA__ADG21918

SEQ ID NO: 4780 - protein, 566 aa, Artificial Sequence
  hemagglutinin__InfluenzaA__ADG21919
MKAILVVLLYTFATANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4781 - protein, 566 aa, Artificial Sequence; identical to SEQ ID NO: 2911
  hemagglutinin__InfluenzaA__ADG21921

SEQ ID NO: 4782 - protein, 566 aa, Artificial Sequence; identical to SEQ ID NO: 2669
  hemagglutinin__InfluenzaA__ADG21922

SEQ ID NO: 4783 - protein, 566 aa, Artificial Sequence
  hemagglutinin__InfluenzaA__ADG21923
MKAILVVLLYTFATANADTLCIGYHANNSTDTVDTVLEKNVTVTHSANLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4784 - protein, 566 aa, Artificial Sequence
  hemagglutinin__InfluenzaA__ADG21924
MEAILVVLLYTFATANADTLCIGYHANNSTDTVDTVLEKNVTVTHSVNLLENKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4785 - protein, 566 aa, Artificial Sequence
  hemagglutinin__InfluenzaA__ADG21925
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4786 - protein, 566 aa, Artificial Sequence
  hemagglutinin__InfluenzaA__ADG21926
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERNLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4787 - protein, 566 aa, Artificial Sequence; identical to SEQ ID NO: 2911
  hemagglutinin__InfluenzaA__ADG21927

SEQ ID NO: 4788 - protein, 566 aa, Artificial Sequence
  hemagglutinin__InfluenzaA__ADG21928
MKATLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPRVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4789 - protein, 566 aa, Artificial Sequence; identical to SEQ ID NO: 4785
  hemagglutinin__InfluenzaA__ADG21930

SEQ ID NO: 4790 - protein, 566 aa, Artificial Sequence; identical to SEQ ID NO: 2911
  hemagglutinin__InfluenzaA__ADG21931

SEQ ID NO: 4791 - protein, 566 aa, Artificial Sequence; identical to SEQ ID NO: 2911
  hemagglutinin__InfluenzaA__ADG21932

SEQ ID NO: 4792 - protein, 566 aa, Artificial Sequence; identical to SEQ ID NO: 2911
  hemagglutinin__InfluenzaA__ADG21933

SEQ ID NO: 4793 - protein, 566 aa, Artificial Sequence; identical to SEQ ID NO: 4785
  hemagglutinin__InfluenzaA__ADG21934

SEQ ID NO: 4794 - protein, 566 aa, Artificial Sequence
  hemagglutinin__InfluenzaA__ADG21935
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTNCQTPNGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4795 - protein, 566 aa, Artificial Sequence; identical to SEQ ID NO: 2911
  hemagglutinin__InfluenzaA__ADG21936

SEQ ID NO: 4796 - protein, 566 aa, Artificial Sequence; identical to SEQ ID NO: 2911
  hemagglutinin__InfluenzaA__ADG21937

SEQ ID NO: 4797 - protein, 566 aa, Artificial Sequence
  hemagglutinin__InfluenzaA__ADG21938
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERNLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4798 - protein, 566 aa, Artificial Sequence; identical to SEQ ID NO: 2911
  hemagglutinin__InfluenzaA__ADG21939

SEQ ID NO: 4799 - protein, 566 aa, Artificial Sequence; identical to SEQ ID NO: 2911
  hemagglutinin__InfluenzaA__ADG21940

SEQ ID NO: 4800 - protein, 566 aa, Artificial Sequence
  hemagglutinin__InfluenzaA__ADG21941
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4801 - protein, 566 aa, Artificial Sequence
  hemagglutinin__InfluenzaA__ADG21943
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4802 - protein, 566 aa, Artificial Sequence
  hemagglutinin__InfluenzaA__ADG21944
MEAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4803 - protein, 566 aa, Artificial Sequence; identical to SEQ ID NO: 2911
  hemagglutinin__InfluenzaA__ADG21945

SEQ ID NO: 4804 - protein, 566 aa, Artificial Sequence; identical to SEQ ID NO: 2911
  hemagglutinin__InfluenzaA__ADG21946

SEQ ID NO: 4805 - protein, 566 aa, Artificial Sequence; identical to SEQ ID NO: 2911
  hemagglutinin__InfluenzaA__ADG21947

SEQ ID NO: 4806 - protein, 566 aa, Artificial Sequence
  hemagglutinin__InfluenzaA__ADG21948
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDHHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4807 - protein, 566 aa, Artificial Sequence
  hemagglutinin__InfluenzaA__ADG27794
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRTYQILAIYSTVASSLVLVVSLGAISFWMCSNGSLQCRICI

SEQ ID NO: 4808 - protein, 566 aa, Artificial Sequence; identical to SEQ ID NO: 2656
  hemagglutinin__InfluenzaA__ADG27948

SEQ ID NO: 4809 - protein, 566 aa, Artificial Sequence; identical to SEQ ID NO: 2656
  hemagglutinin__InfluenzaA__ADG27966

SEQ ID NO: 4810 - protein, 566 aa, Artificial Sequence
  hemagglutinin__InfluenzaA__ADG27974
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLILVVSLGAISFWMCSNGSLQCRICI

SEQ ID NO: 4811 - protein, 566 aa, Artificial Sequence
  hemagglutinin__InfluenzaA__ADG27982
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4812 - protein, 566 aa, Artificial Sequence; identical to SEQ ID NO: 2656
  hemagglutinin__InfluenzaA__ADG27988

SEQ ID NO: 4813 - protein, 566 aa, Artificial Sequence; identical to SEQ ID NO: 2656
  hemagglutinin__InfluenzaA__ADG27997

SEQ ID NO: 4814 - protein, 566 aa, Artificial Sequence; identical to SEQ ID NO: 2656
  hemagglutinin__InfluenzaA__ADG28011

SEQ ID NO: 4815 - protein, 566 aa, Artificial Sequence; identical to SEQ ID NO: 4221
  hemagglutinin__InfluenzaA__ADG42093

SEQ ID NO: 4816 - protein, 566 aa, Artificial Sequence; identical to SEQ ID NO: 3833
  hemagglutinin__InfluenzaA__ADG42103

SEQ ID NO: 4817 - protein, 566 aa, Artificial Sequence; identical to SEQ ID NO: 3022
  hemagglutinin__InfluenzaA__ADG42113

SEQ ID NO: 4818 - protein, 566 aa, Artificial Sequence; identical to SEQ ID NO: 4221
  hemagglutinin__InfluenzaA__ADG42123

SEQ ID NO: 4819 - protein, 566 aa, Artificial Sequence
  hemagglutinin__InfluenzaA__ADG42133
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPYAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLVTGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4820 - protein, 566 aa, Artificial Sequence
  hemagglutinin__InfluenzaA__ADG42143
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 4821 - protein, 566 aa, Artificial Sequence
  hemagglutinin__InfluenzaA__ADG42153
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVLDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4822 - protein, 566 aa, Artificial Sequence; identical to SEQ ID NO: 2669
  hemagglutinin__InfluenzaA__ADG42193

SEQ ID NO: 4823 - protein, 566 aa, Artificial Sequence; identical to SEQ ID NO: 2669
  hemagglutinin__InfluenzaA__ADG42213

SEQ ID NO: 4824 - protein, 566 aa, Artificial Sequence; identical to SEQ ID NO: 2669
  hemagglutinin__InfluenzaA__ADG42233

SEQ ID NO: 4825 - protein, 566 aa, Artificial Sequence
  hemagglutinin__InfluenzaA__ADG42243
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVLDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4826 - protein, 566 aa, Artificial Sequence; identical to SEQ ID NO: 4089
  hemagglutinin__InfluenzaA__ADG42253

SEQ ID NO: 4827 - protein, 566 aa, Artificial Sequence; identical to SEQ ID NO: 2669
  hemagglutinin__InfluenzaA__ADG42263

SEQ ID NO: 4828 - protein, 566 aa, Artificial Sequence; identical to SEQ ID NO: 3770
  hemagglutinin__InfluenzaA__ADG42273

SEQ ID NO: 4829 - protein, 566 aa, Artificial Sequence; identical to SEQ ID NO: 3770
  hemagglutinin__InfluenzaA__ADG42283

SEQ ID NO: 4830 - protein, 566 aa, Artificial Sequence; identical to SEQ ID NO: 4352
  hemagglutinin__InfluenzaA__ADG42293

SEQ ID NO: 4831 - protein, 566 aa, Artificial Sequence
  hemagglutinin__InfluenzaA__ADG42303
MKAILVVLLYTFATANADTLCIGYHANNSTDTVDTVLEKNVTVTHSVNLLEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4832 - protein, 566 aa, Artificial Sequence; identical to SEQ ID NO: 4379
  hemagglutinin__InfluenzaA__ADG42313

SEQ ID NO: 4833 - protein, 566 aa, Artificial Sequence
  hemagglutinin__InfluenzaA__ADG42323
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4834 - protein, 566 aa, Artificial Sequence
  hemagglutinin__InfluenzaA__ADG42333
MKAILVVLLYTLATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDAPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4835 - protein, 566 aa, Artificial Sequence
  hemagglutinin__InfluenzaA__ADG42343
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMESNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4836 - protein, 566 aa, Artificial Sequence
  hemagglutinin__InfluenzaA__ADG42363
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4837 - protein, 566 aa, Artificial Sequence
  hemagglutinin__InfluenzaA__ADG42373
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4838 - protein, 566 aa, Artificial Sequence
  hemagglutinin__InfluenzaA__ADG42393
MKAILVVLLYTFATANADTLCIGYHANNSTDTVDTVLEKNVTVTHSVNLLEDKHNEKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLLVSLGAISFWMCSNGSLQCRICI

SEQ ID NO: 4839 - protein, 566 aa, Artificial Sequence; identical to SEQ ID NO: 3833
  hemagglutinin__InfluenzaA__ADG42403

SEQ ID NO: 4840 - protein, 566 aa, Artificial Sequence; identical to SEQ ID NO: 4089
  hemagglutinin__InfluenzaA__ADG42413

SEQ ID NO: 4841 - protein, 566 aa, Artificial Sequence; identical to SEQ ID NO: 4836
  hemagglutinin__InfluenzaA__ADG42423

SEQ ID NO: 4842 - protein, 566 aa, Artificial Sequence; identical to SEQ ID NO: 4089
  hemagglutinin__InfluenzaA__ADG42443

SEQ ID NO: 4843 - protein, 566 aa, Artificial Sequence
  hemagglutinin__InfluenzaA__ADG42453
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRVENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4844 - protein, 566 aa, Artificial Sequence; identical to SEQ ID NO: 3022
  hemagglutinin__InfluenzaA__ADG42463

SEQ ID NO: 4845 - protein, 566 aa, Artificial Sequence; identical to SEQ ID NO: 2669
  hemagglutinin__InfluenzaA__ADG42473

SEQ ID NO: 4846 - protein, 566 aa, Artificial Sequence; identical to SEQ ID NO: 4089
  hemagglutinin__InfluenzaA__ADG42483

SEQ ID NO: 4847 - protein, 566 aa, Artificial Sequence; identical to SEQ ID NO: 4221
  hemagglutinin__InfluenzaA__ADG42493

SEQ ID NO: 4848 - protein, 566 aa, Artificial Sequence; identical to SEQ ID NO: 4282
  hemagglutinin__InfluenzaA__ADG42503

SEQ ID NO: 4849 - protein, 566 aa, Artificial Sequence; identical to SEQ ID NO: 3770
  hemagglutinin__InfluenzaA__ADG42513

SEQ ID NO: 4850 - protein, 566 aa, Artificial Sequence
  hemagglutinin__InfluenzaA__ADG42533
MKAILVVLLYTFATAKADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4851 - protein, 566 aa, Artificial Sequence
  hemagglutinin__InfluenzaA__ADG42553
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLNKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4852 - protein, 566 aa, Artificial Sequence
  hemagglutinin__InfluenzaA__ADG42573
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLIEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4853 - protein, 566 aa, Artificial Sequence
  hemagglutinin__InfluenzaA__ADG42583
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4854 - protein, 566 aa, Artificial Sequence; identical to SEQ ID NO: 4266
  hemagglutinin__InfluenzaA__ADG42593

SEQ ID NO: 4855 - protein, 566 aa, Artificial Sequence
  hemagglutinin__InfluenzaA__ADG42603
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLRKSYINDKGKEVLVLWGIHHPSTSADQQSLYQNADAYVFVGTSRYSKKFKPEIATRPKVRDQEGRMNYYWTLVEPGDKITFEATGNLVVPRYAFAMERNAGSGIIISDTPVHDCNTTCQTPKGSINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4856 - protein, 566 aa, Artificial Sequence
  hemagglutinin__InfluenzaA__ADG42613
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 4857 - protein, 566 aa, Artificial Sequence; identical to SEQ ID NO: 4296
  hemagglutinin__InfluenzaA__ADG42623

SEQ ID NO: 4858 - protein, 566 aa, Artificial Sequence; identical to SEQ ID NO: 2669
  hemagglutinin__InfluenzaA__ADG42633

SEQ ID NO: 4859 - protein, 566 aa, Artificial Sequence
  hemagglutinin__InfluenzaA__ADG42643
MKAILVVLLYTFATANADTLCIGYHANNSTDTVDTVLEKNVTVTHSANLLEDKHNGKLCKLRGAAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYVNDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4860 - protein, 566 aa, Artificial Sequence
  hemagglutinin__InfluenzaA__ADG42653
MKAILVVLLYTSATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4861 - protein, 566 aa, Artificial Sequence; identical to SEQ ID NO: 3833
  hemagglutinin__InfluenzaA__ADG42663

SEQ ID NO: 4862 - protein, 566 aa, Artificial Sequence
  hemagglutinin__InfluenzaA__ADG42673
MKAILVVLLYTFATANADTLCIGYHANNSTDTVDTVLEKNVTVTHSVNLLEDKHNGKLCKLKGVAPLHLGKCNIAGWILGNPECESLSTAGSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4863 - protein, 566 aa, Artificial Sequence
  hemagglutinin__InfluenzaA__ADG42683
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGNFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4864 - protein, 566 aa, Artificial Sequence; identical to SEQ ID NO: 3833
  hemagglutinin__InfluenzaA__ADG42693

SEQ ID NO: 4865 - protein, 566 aa, Artificial Sequence; identical to SEQ ID NO: 4541
  hemagglutinin__InfluenzaA__ADG42703

SEQ ID NO: 4866 - protein, 566 aa, Artificial Sequence
  hemagglutinin__InfluenzaA__ADG42723
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEMAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4867 - protein, 566 aa, Artificial Sequence; identical to SEQ ID NO: 4296
  hemagglutinin__InfluenzaA__ADG42743

SEQ ID NO: 4868 - protein, 566 aa, Artificial Sequence
  hemagglutinin__InfluenzaA__ADG42753
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNSGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4869 - protein, 566 aa, Artificial Sequence; identical to SEQ ID NO: 3833
  hemagglutinin__InfluenzaA__ADG42763

SEQ ID NO: 4870 - protein, 566 aa, Artificial Sequence; identical to SEQ ID NO: 3833
  hemagglutinin__InfluenzaA__ADG42773

SEQ ID NO: 4871 - protein, 566 aa, Artificial Sequence
  hemagglutinin__InfluenzaA__ADG42783
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4872 - protein, 566 aa, Artificial Sequence; identical to SEQ ID NO: 3833
  hemagglutinin__InfluenzaA__ADG42793

SEQ ID NO: 4873 - protein, 566 aa, Artificial Sequence; identical to SEQ ID NO: 4871
  hemagglutinin__InfluenzaA__ADG42803

SEQ ID NO: 4874 - protein, 566 aa, Artificial Sequence; identical to SEQ ID NO: 4221
  hemagglutinin__InfluenzaA__ADG42813

SEQ ID NO: 4875 - protein, 566 aa, Artificial Sequence; identical to SEQ ID NO: 4364
  hemagglutinin__InfluenzaA__ADG42823

SEQ ID NO: 4876 - protein, 566 aa, Artificial Sequence; identical to SEQ ID NO: 4266
  hemagglutinin__InfluenzaA__ADG42833

SEQ ID NO: 4877 - protein, 566 aa, Artificial Sequence; identical to SEQ ID NO: 3833
  hemagglutinin__InfluenzaA__ADG42843

SEQ ID NO: 4878 - protein, 566 aa, Artificial Sequence; identical to SEQ ID NO: 3833
  hemagglutinin__InfluenzaA__ADG42853

SEQ ID NO: 4879 - protein, 566 aa, Artificial Sequence; identical to SEQ ID NO: 4387
  hemagglutinin__InfluenzaA__ADG42863

SEQ ID NO: 4880 - protein, 566 aa, Artificial Sequence; identical to SEQ ID NO: 4407
  hemagglutinin__InfluenzaA__ADG42883

SEQ ID NO: 4881 - protein, 566 aa, Artificial Sequence
  hemagglutinin__InfluenzaA__ADG42893
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTNLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4882 - protein, 566 aa, Artificial Sequence; identical to SEQ ID NO: 2669
  hemagglutinin__InfluenzaA__ADG42903

SEQ ID NO: 4883 - protein, 566 aa, Artificial Sequence; identical to SEQ ID NO: 3833
  hemagglutinin__InfluenzaA__ADG42913

SEQ ID NO: 4884 - protein, 566 aa, Artificial Sequence; identical to SEQ ID NO: 4397
  hemagglutinin__InfluenzaA__ADG42923

SEQ ID NO: 4885 - protein, 566 aa, Artificial Sequence
  hemagglutinin__InfluenzaA__ADG57087
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVAISLVLVVSLGAISFWMCSNGSLRCRICI

SEQ ID NO: 4886 - protein, 566 aa, Artificial Sequence; identical to SEQ ID NO: 2669
  hemagglutinin__InfluenzaA__ADG57088

SEQ ID NO: 4887 - protein, 566 aa, Artificial Sequence
  hemagglutinin__InfluenzaA__ADG57089
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIQYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAEEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4888 - protein, 566 aa, Artificial Sequence
  hemagglutinin__InfluenzaA__ADG57090
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSIYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAQLLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4889 - protein, 566 aa, Artificial Sequence
  hemagglutinin__InfluenzaA__ADG57091
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIERGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4890 - protein, 566 aa, Artificial Sequence
  hemagglutinin__InfluenzaA__ADG57092
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLIKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4891 - protein, 566 aa, Artificial Sequence
  hemagglutinin__InfluenzaA__ADG57093
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVWSSRYSKKFKPEIAIRPKVRDQEGRMNYYWTLVEPGDKITFEATGNLLVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4892 - protein, 566 aa, Artificial Sequence
  hemagglutinin__InfluenzaA__ADG57094
MKAILVVLLYTFATANADTLCVGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4893 - protein, 566 aa, Artificial Sequence; identical to SEQ ID NO: 2669
  hemagglutinin__InfluenzaA__ADG57095

SEQ ID NO: 4894 - protein, 566 aa, Artificial Sequence
  hemagglutinin__InfluenzaA__ADG57097
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRGQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4895 - protein, 566 aa, Artificial Sequence; identical to SEQ ID NO: 3833
  hemagglutinin__InfluenzaA__ADG57098

SEQ ID NO: 4896 - protein, 566 aa, Artificial Sequence
  hemagglutinin__InfluenzaA__ADG57099
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIITDTPVHDCNTTCQTPKGAVNTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4897 - protein, 566 aa, Artificial Sequence
  hemagglutinin__InfluenzaA__ADG57100
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAGGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4898 - protein, 566 aa, Artificial Sequence; identical to SEQ ID NO: 2669
  hemagglutinin__InfluenzaA__ADG58939

SEQ ID NO: 4899 - protein, 566 aa, Artificial Sequence; identical to SEQ ID NO: 2669
  hemagglutinin__InfluenzaA__ADG58940

SEQ ID NO: 4900 - protein, 566 aa, Artificial Sequence
  hemagglutinin__InfluenzaA__ADG58941
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHENEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4901 - protein, 566 aa, Artificial Sequence
  hemagglutinin__InfluenzaA__ADG58942
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYLHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4902 - protein, 566 aa, Artificial Sequence; identical to SEQ ID NO: 2669
  hemagglutinin__InfluenzaA__ADG58943

SEQ ID NO: 4903 - protein, 566 aa, Artificial Sequence
  hemagglutinin__InfluenzaA__ADG58944
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4904 - protein, 566 aa, Artificial Sequence; identical to SEQ ID NO: 3467
  hemagglutinin__InfluenzaA__ADG58946

SEQ ID NO: 4905 - protein, 566 aa, Artificial Sequence; identical to SEQ ID NO: 2669
  hemagglutinin__InfluenzaA__ADG58947

SEQ ID NO: 4906 - protein, 566 aa, Artificial Sequence
  hemagglutinin__InfluenzaA__ADG58948
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4907 - protein, 566 aa, Artificial Sequence
  hemagglutinin__InfluenzaA__ADG58949
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4908 - protein, 566 aa, Artificial Sequence
  hemagglutinin__InfluenzaA__ADG58951
MKAILVVLLHTFATANADTLCIGYHANNSTDTVDTVLEKNVTVTHSVNLLEDKHNGKLCKLRGVAPLHLGKCNIAGWILGNPECESLSTASSWSYIVETSNSGNGTCYPGEFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCIESVKNGTYDYPKYSEEAKLNREEIDGVKLESTRIYQILAIYSTVASSLVLVVSLGAISFWMCSNGSLQCRICI

SEQ ID NO: 4909 - protein, 566 aa, Artificial Sequence; identical to SEQ ID NO: 4908
  hemagglutinin__InfluenzaA__ADG58952

SEQ ID NO: 4910 - protein, 566 aa, Artificial Sequence; identical to SEQ ID NO: 4908
  hemagglutinin__InfluenzaA__ADG58953

SEQ ID NO: 4911 - protein, 566 aa, Artificial Sequence; identical to SEQ ID NO: 4908
  hemagglutinin__InfluenzaA__ADG58954

SEQ ID NO: 4912 - protein, 566 aa, Artificial Sequence; identical to SEQ ID NO: 4908
  hemagglutinin__InfluenzaA__ADG58955

SEQ ID NO: 4913 - protein, 566 aa, Artificial Sequence; identical to SEQ ID NO: 4908
  hemagglutinin__InfluenzaA__ADG58956

SEQ ID NO: 4914 - protein, 566 aa, Artificial Sequence
  hemagglutinin__InfluenzaA__ADG58957
MKAILVVLLHTFATANADTLCIGYHANNSTDTVDTVLEKNVTVTHSVNLLEDKHNGKLCKLRGVAPLHLGKCNIAGWILGNPECESLSTASSWSYIVETSNSGNGTCYPGEFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4915 - protein, 566 aa, Artificial Sequence
  hemagglutinin__InfluenzaA__ADG58959
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4916 - protein, 566 aa, Artificial Sequence; identical to SEQ ID NO: 4833
  hemagglutinin__InfluenzaA__ADG58960

SEQ ID NO: 4917 - protein, 566 aa, Artificial Sequence; identical to SEQ ID NO: 4833
  hemagglutinin__InfluenzaA__ADG58961

SEQ ID NO: 4918 - protein, 566 aa, Artificial Sequence; identical to SEQ ID NO: 4833
  hemagglutinin__InfluenzaA__ADG58962

SEQ ID NO: 4919 - protein, 566 aa, Artificial Sequence; identical to SEQ ID NO: 4833
  hemagglutinin__InfluenzaA__ADG58963

SEQ ID NO: 4920 - protein, 566 aa, Artificial Sequence; identical to SEQ ID NO: 4833
  hemagglutinin__InfluenzaA__ADG58964

SEQ ID NO: 4921 - protein, 566 aa, Artificial Sequence; identical to SEQ ID NO: 4833
  hemagglutinin__InfluenzaA__ADG58965

SEQ ID NO: 4922 - protein, 566 aa, Artificial Sequence; identical to SEQ ID NO: 4833
  hemagglutinin__InfluenzaA__ADG58966

SEQ ID NO: 4923 - protein, 566 aa, Artificial Sequence; identical to SEQ ID NO: 4833
  hemagglutinin__InfluenzaA__ADG58967

SEQ ID NO: 4924 - protein, 566 aa, Artificial Sequence; identical to SEQ ID NO: 4833
  hemagglutinin__InfluenzaA__ADG58968

SEQ ID NO: 4925 - protein, 566 aa, Artificial Sequence; identical to SEQ ID NO: 2669
  hemagglutinin__InfluenzaA__ADG59628

SEQ ID NO: 4926 - protein, 566 aa, Artificial Sequence; identical to SEQ ID NO: 2669
  hemagglutinin__InfluenzaA__ADG59629

SEQ ID NO: 4927 - protein, 566 aa, Artificial Sequence; identical to SEQ ID NO: 2669
  hemagglutinin__InfluenzaA__ADG59630

SEQ ID NO: 4928 - protein, 566 aa, Artificial Sequence; identical to SEQ ID NO: 2669
  hemagglutinin__InfluenzaA__ADG59631

SEQ ID NO: 4929 - protein, 566 aa, Artificial Sequence; identical to SEQ ID NO: 2669
  hemagglutinin__InfluenzaA__ADG59632

SEQ ID NO: 4930 - protein, 566 aa, Artificial Sequence; identical to SEQ ID NO: 3770
  hemagglutinin__InfluenzaA__ADG59633

SEQ ID NO: 4931 - protein, 566 aa, Artificial Sequence; identical to SEQ ID NO: 3770
  hemagglutinin__InfluenzaA__ADG59634

SEQ ID NO: 4932 - protein, 566 aa, Artificial Sequence; identical to SEQ ID NO: 2669
  hemagglutinin__InfluenzaA__ADG59635

SEQ ID NO: 4933 - protein, 566 aa, Artificial Sequence
  hemagglutinin__InfluenzaA__ADG59636
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4934 - protein, 566 aa, Artificial Sequence; identical to SEQ ID NO: 3417
  hemagglutinin__InfluenzaA__ADG59638

SEQ ID NO: 4935 - protein, 566 aa, Artificial Sequence; identical to SEQ ID NO: 3770
  hemagglutinin__InfluenzaA__ADG59639

SEQ ID NO: 4936 - protein, 566 aa, Artificial Sequence; identical to SEQ ID NO: 3022
  hemagglutinin__InfluenzaA__ADG59641

SEQ ID NO: 4937 - protein, 566 aa, Artificial Sequence; identical to SEQ ID NO: 3512
  hemagglutinin__InfluenzaA__ADG59643

SEQ ID NO: 4938 - protein, 566 aa, Artificial Sequence; identical to SEQ ID NO: 2656
  hemagglutinin__InfluenzaA__ADG59644

SEQ ID NO: 4939 - protein, 566 aa, Artificial Sequence; identical to SEQ ID NO: 2669
  hemagglutinin__InfluenzaA__ADG59646

SEQ ID NO: 4940 - protein, 566 aa, Artificial Sequence; identical to SEQ ID NO: 3770
  hemagglutinin__InfluenzaA__ADG59647

SEQ ID NO: 4941 - protein, 566 aa, Artificial Sequence; identical to SEQ ID NO: 3833
  hemagglutinin__InfluenzaA__ADG59648

SEQ ID NO: 4942 - protein, 566 aa, Artificial Sequence; identical to SEQ ID NO: 3833
  hemagglutinin__InfluenzaA__ADG59649

SEQ ID NO: 4943 - protein, 566 aa, Artificial Sequence; identical to SEQ ID NO: 3833
  hemagglutinin__InfluenzaA__ADG59650

SEQ ID NO: 4944 - protein, 566 aa, Artificial Sequence; identical to SEQ ID NO: 3833
  hemagglutinin__InfluenzaA__ADG59651

SEQ ID NO: 4945 - protein, 566 aa, Artificial Sequence; identical to SEQ ID NO: 2669
  hemagglutinin__InfluenzaA__ADG59652

SEQ ID NO: 4946 - protein, 566 aa, Artificial Sequence; identical to SEQ ID NO: 2669
  hemagglutinin__InfluenzaA__ADG59653

SEQ ID NO: 4947 - protein, 566 aa, Artificial Sequence; identical to SEQ ID NO: 4933
  hemagglutinin__InfluenzaA__ADG59655

SEQ ID NO: 4948 - protein, 566 aa, Artificial Sequence; identical to SEQ ID NO: 3770
  hemagglutinin__InfluenzaA__ADG59656

SEQ ID NO: 4949 - protein, 566 aa, Artificial Sequence
  hemagglutinin__InfluenzaA__ADG59657
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSTQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4950 - protein, 566 aa, Artificial Sequence
  hemagglutinin__InfluenzaA__ADG59658
MKAILVVLLYTFATANADTLCIGYHANNSTDTIDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4951 - protein, 566 aa, Artificial Sequence; identical to SEQ ID NO: 3116
  hemagglutinin__InfluenzaA__ADG59659

SEQ ID NO: 4952 - protein, 566 aa, Artificial Sequence; identical to SEQ ID NO: 3116
  hemagglutinin__InfluenzaA__ADG59660

SEQ ID NO: 4953 - protein, 566 aa, Artificial Sequence; identical to SEQ ID NO: 3022
  hemagglutinin__InfluenzaA__ADG59662

SEQ ID NO: 4954 - protein, 566 aa, Artificial Sequence
  hemagglutinin__InfluenzaA__ADG59663
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPFHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4955 - protein, 566 aa, Artificial Sequence; identical to SEQ ID NO: 3022
  hemagglutinin__InfluenzaA__ADG59664

SEQ ID NO: 4956 - protein, 566 aa, Artificial Sequence
  hemagglutinin__InfluenzaA__ADG59666
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSAVASSLVLVVSLGAISFWMCSNGSLQCRICI

SEQ ID NO: 4957 - protein, 566 aa, Artificial Sequence; identical to SEQ ID NO: 3771
  hemagglutinin__InfluenzaA__ADG59667

SEQ ID NO: 4958 - protein, 566 aa, Artificial Sequence
  hemagglutinin__InfluenzaA__ADG59669
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVDPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4959 - protein, 566 aa, Artificial Sequence; identical to SEQ ID NO: 4958
  hemagglutinin__InfluenzaA__ADG59670

SEQ ID NO: 4960 - protein, 566 aa, Artificial Sequence; identical to SEQ ID NO: 4958
  hemagglutinin__InfluenzaA__ADG59671

SEQ ID NO: 4961 - protein, 566 aa, Artificial Sequence; identical to SEQ ID NO: 4958
  hemagglutinin__InfluenzaA__ADG59672

SEQ ID NO: 4962 - protein, 566 aa, Artificial Sequence
  hemagglutinin__InfluenzaA__ADG59673
MKAILVVLLYTFATANADTLCIGYHANNSTDTVDTVLEKNVTVTHSVDLLEDKHNGKLCKLRGVAPLHLGECNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4963 - protein, 566 aa, Artificial Sequence
  hemagglutinin__InfluenzaA__ADG59674
MKAILVVLLYTFATANADTLCVGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 4964 - protein, 566 aa, Artificial Sequence
  hemagglutinin__InfluenzaA__ADG59675
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPNGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4965 - protein, 566 aa, Artificial Sequence
  hemagglutinin__InfluenzaA__ADG59676
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNATCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4966 - protein, 566 aa, Artificial Sequence; identical to SEQ ID NO: 3770
  hemagglutinin__InfluenzaA__ADG59678

SEQ ID NO: 4967 - protein, 566 aa, Artificial Sequence; identical to SEQ ID NO: 4933
  hemagglutinin__InfluenzaA__ADG59680

SEQ ID NO: 4968 - protein, 566 aa, Artificial Sequence; identical to SEQ ID NO: 4933
  hemagglutinin__InfluenzaA__ADG59681

SEQ ID NO: 4969 - protein, 566 aa, Artificial Sequence
  hemagglutinin__InfluenzaA__ADG59683
MKAILVVLLYTFAIANADTLCIGYHANNSTDTVDTVLKKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4970 - protein, 566 aa, Artificial Sequence; identical to SEQ ID NO: 3770
  hemagglutinin__InfluenzaA__ADG59684

SEQ ID NO: 4971 - protein, 566 aa, Artificial Sequence
  hemagglutinin__InfluenzaA__ADG59685
MKAILVVLLYTFATANADTLCIGYHANNSTDTIDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4972 - protein, 566 aa, Artificial Sequence; identical to SEQ ID NO: 3770
  hemagglutinin__InfluenzaA__ADG59686

SEQ ID NO: 4973 - protein, 566 aa, Artificial Sequence; identical to SEQ ID NO: 4933
  hemagglutinin__InfluenzaA__ADG59687

SEQ ID NO: 4974 - protein, 566 aa, Artificial Sequence
  hemagglutinin__InfluenzaA__ADG59688
MKAILVVLLYTIATANADTLCIGYHANNSTDTIDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4975 - protein, 566 aa, Artificial Sequence; identical to SEQ ID NO: 2669
  hemagglutinin__InfluenzaA__ADG59689

SEQ ID NO: 4976 - protein, 566 aa, Artificial Sequence; identical to SEQ ID NO: 2669
  hemagglutinin__InfluenzaA__ADG59691

SEQ ID NO: 4977 - protein, 566 aa, Artificial Sequence
  hemagglutinin__InfluenzaA__ADG59693
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4978 - protein, 566 aa, Artificial Sequence
  hemagglutinin__InfluenzaA__ADG59696
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4979 - protein, 566 aa, Artificial Sequence
  hemagglutinin__InfluenzaA__ADG59697
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKNFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4980 - protein, 566 aa, Artificial Sequence
  hemagglutinin__InfluenzaA__ADG59700
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTLKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4981 - protein, 566 aa, Artificial Sequence
  hemagglutinin__InfluenzaA__ADG59701
MKAILVVLLYTFAAANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4982 - protein, 566 aa, Artificial Sequence
  hemagglutinin__InfluenzaA__ADG59702
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERNLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4983 - protein, 566 aa, Artificial Sequence
  hemagglutinin__InfluenzaA__ADG59703
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4984 - protein, 566 aa, Artificial Sequence; identical to SEQ ID NO: 2684
  hemagglutinin__InfluenzaA__ADG76646

SEQ ID NO: 4985 - protein, 566 aa, Artificial Sequence
  hemagglutinin__InfluenzaA__ADG76652
MKAILVVLLYTFATANADTLCIGYHANNSTDTVDTVLEKNVTVTHSVNLLEDKHNGKLCKLRGVAPLHLGKCNIAGWILGNPECESFSTSSSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4986 - protein, 566 aa, Artificial Sequence; identical to SEQ ID NO: 2911
  hemagglutinin__InfluenzaA__ADH01808

SEQ ID NO: 4987 - protein, 566 aa, Artificial Sequence
  hemagglutinin__InfluenzaA__ADH01818
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 4988 - protein, 566 aa, Artificial Sequence; identical to SEQ ID NO: 2911
  hemagglutinin__InfluenzaA__ADH01828

SEQ ID NO: 4989 - protein, 566 aa, Artificial Sequence; identical to SEQ ID NO: 2669
  hemagglutinin__InfluenzaA__ADH01838

SEQ ID NO: 4990 - protein, 566 aa, Artificial Sequence; identical to SEQ ID NO: 2911
  hemagglutinin__InfluenzaA__ADH01848

SEQ ID NO: 4991 - protein, 566 aa, Artificial Sequence; identical to SEQ ID NO: 2911
  hemagglutinin__InfluenzaA__ADH01858

SEQ ID NO: 4992 - protein, 566 aa, Artificial Sequence; identical to SEQ ID NO: 2669
  hemagglutinin__InfluenzaA__ADH01868

SEQ ID NO: 4993 - protein, 566 aa, Artificial Sequence; identical to SEQ ID NO: 2669
  hemagglutinin__InfluenzaA__ADH01878

SEQ ID NO: 4994 - protein, 566 aa, Artificial Sequence; identical to SEQ ID NO: 2911
  hemagglutinin__InfluenzaA__ADH01888

SEQ ID NO: 4995 - protein, 566 aa, Artificial Sequence; identical to SEQ ID NO: 2669
  hemagglutinin__InfluenzaA__ADH01898

SEQ ID NO: 4996 - protein, 566 aa, Artificial Sequence; identical to SEQ ID NO: 2760
  hemagglutinin__InfluenzaA__ADH01908

SEQ ID NO: 4997 - protein, 566 aa, Artificial Sequence
  hemagglutinin__InfluenzaA__ADH01918
MKAILVVLLYTFATANADTLCIGYHANNSTDTVDTVLEKNVTVTHSVNLLEDKHNGKLCKLRGVAPLHLGKCNIAGWILGNPECESLSTESSWSYIVETSSSDNGTCYPGDFIDYEELREQLSSVSSFERFEIFPKTSSWPNHDSNKGVTAACPHAGAKSFYKNLIWLVKKGNSYPKLSKSYINDKEKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4998 - protein, 566 aa, Artificial Sequence
  hemagglutinin__InfluenzaA__ADH01928
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSASSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 4999 - protein, 566 aa, Artificial Sequence
  hemagglutinin__InfluenzaA__ADH01938
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYKKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5000 - protein, 566 aa, Artificial Sequence; identical to SEQ ID NO: 3833
  hemagglutinin__InfluenzaA__ADH01948

SEQ ID NO: 5001 - protein, 566 aa, Artificial Sequence
  hemagglutinin__InfluenzaA__ADH01958
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGNCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 5002 - protein, 566 aa, Artificial Sequence
  hemagglutinin__InfluenzaA__ADH01968
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5003 - protein, 566 aa, Artificial Sequence; identical to SEQ ID NO: 3833
  hemagglutinin__InfluenzaA__ADH01978

SEQ ID NO: 5004 - protein, 566 aa, Artificial Sequence; identical to SEQ ID NO: 3833
  hemagglutinin__InfluenzaA__ADH01988

SEQ ID NO: 5005 - protein, 566 aa, Artificial Sequence; identical to SEQ ID NO: 4836
  hemagglutinin__InfluenzaA__ADH01998

SEQ ID NO: 5006 - protein, 566 aa, Artificial Sequence
  hemagglutinin__InfluenzaA__ADH02008
MKAILVVLLYTFATANADTLCIGYHANNSTDTVDTVLEKNVTVTHSVNLLEGKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLIKKGNSYPKLSKSYINDKEKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5007 - protein, 566 aa, Artificial Sequence; identical to SEQ ID NO: 3833
  hemagglutinin__InfluenzaA__ADI24508

SEQ ID NO: 5008 - protein, 566 aa, Artificial Sequence
  hemagglutinin__InfluenzaA__ADI24515
MKAILVVLLYTFATANADTLCVGYHANNSTDTVDTVLEKNVTVTHSVNLLEDKHNGKLCKLRGVAPLHLGKCNIAGWILGNPECESLPTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKSTNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5009 - protein, 566 aa, Artificial Sequence; identical to SEQ ID NO: 3833
  hemagglutinin__InfluenzaA__ADI24517

SEQ ID NO: 5010 - protein, 566 aa, Artificial Sequence; identical to SEQ ID NO: 3833
  hemagglutinin__InfluenzaA__ADI24519

SEQ ID NO: 5011 - protein, 566 aa, Artificial Sequence; identical to SEQ ID NO: 3833
  hemagglutinin__InfluenzaA__ADI24521

SEQ ID NO: 5012 - protein, 566 aa, Artificial Sequence; identical to SEQ ID NO: 4221
  hemagglutinin__InfluenzaA__ADI24523

SEQ ID NO: 5013 - protein, 566 aa, Artificial Sequence
  hemagglutinin__InfluenzaA__ADI24525
MKAILVVLLYTFATANADTLCIGYHANNSTDTVDTVLEKNVTVTHSVNLLEDKHNGKLCELRGVAPLHLGKCNIAGWILGNPECESLSTARSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5014 - protein, 566 aa, Artificial Sequence; identical to SEQ ID NO: 3833
  hemagglutinin__InfluenzaA__ADI24527

SEQ ID NO: 5015 - protein, 566 aa, Artificial Sequence; identical to SEQ ID NO: 4221
  hemagglutinin__InfluenzaA__ADI24529

SEQ ID NO: 5016 - protein, 566 aa, Artificial Sequence
  hemagglutinin__InfluenzaA__ADI24531
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLLGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCKICI

SEQ ID NO: 5017 - protein, 566 aa, Artificial Sequence
  hemagglutinin__InfluenzaA__ADI24536
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5018 - protein, 566 aa, Artificial Sequence; identical to SEQ ID NO: 3833
  hemagglutinin__InfluenzaA__ADI24546

SEQ ID NO: 5019 - protein, 566 aa, Artificial Sequence; identical to SEQ ID NO: 3833
  hemagglutinin__InfluenzaA__ADI24553

SEQ ID NO: 5020 - protein, 566 aa, Artificial Sequence; identical to SEQ ID NO: 3833
  hemagglutinin__InfluenzaA__ADI24555

SEQ ID NO: 5021 - protein, 566 aa, Artificial Sequence
  hemagglutinin__InfluenzaA__ADI24557
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5022 - protein, 566 aa, Artificial Sequence; identical to SEQ ID NO: 3833
  hemagglutinin__InfluenzaA__ADI24559

SEQ ID NO: 5023 - protein, 566 aa, Artificial Sequence
  hemagglutinin__InfluenzaA__ADI24561
MKAILVILLYTFATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5024 - protein, 566 aa, Artificial Sequence; identical to SEQ ID NO: 3833
  hemagglutinin__InfluenzaA__ADI24563

SEQ ID NO: 5025 - protein, 566 aa, Artificial Sequence
  hemagglutinin__InfluenzaA__ADI24565
MKAILVVLLYTFATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKKVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5026 - protein, 566 aa, Artificial Sequence; identical to SEQ ID NO: 3833
  hemagglutinin__InfluenzaA__ADI24567

SEQ ID NO: 5027 - protein, 566 aa, Artificial Sequence
  hemagglutinin__InfluenzaA__ADI24569
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAIERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5028 - protein, 566 aa, Artificial Sequence; identical to SEQ ID NO: 3833
  hemagglutinin__InfluenzaA__ADI24571

SEQ ID NO: 5029 - protein, 566 aa, Artificial Sequence; identical to SEQ ID NO: 4221
  hemagglutinin__InfluenzaA__ADI24573

SEQ ID NO: 5030 - protein, 566 aa, Artificial Sequence
  hemagglutinin__InfluenzaA__ADI24575
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVENLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5031 - protein, 566 aa, Artificial Sequence; identical to SEQ ID NO: 3833
  hemagglutinin__InfluenzaA__ADI24577

SEQ ID NO: 5032 - protein, 566 aa, Artificial Sequence
  hemagglutinin__InfluenzaA__ADI24581
MKAILVVLLYTFATANADTLCIGYHANNSTDTVDTVLEKNVTVTHSVNLLEDKHNGKLCKLRGVAPLHLGKCNIAGWVLGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5033 - protein, 566 aa, Artificial Sequence
  hemagglutinin__InfluenzaA__ADI24583
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5034 - protein, 566 aa, Artificial Sequence
  hemagglutinin__InfluenzaA__ADI24590
MKAILVVLLYTFATANADTLCIGYHANNSTDTVDTVLEKNVTVTHSANLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5035 - protein, 566 aa, Artificial Sequence
  hemagglutinin__InfluenzaA__ADI24597
MKAILVVLLYTFATANADTLCIGYHANNSTDTVDTVLEKNVTVTHSANLLEDKHNGKLCKLRGVAPLHLGNCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5036 - protein, 566 aa, Artificial Sequence; identical to SEQ ID NO: 5034
  hemagglutinin__InfluenzaA__ADI24612

SEQ ID NO: 5037 - protein, 566 aa, Artificial Sequence
  hemagglutinin__InfluenzaA__ADI24619
MKAILVVLLYTFATANADTLCIGYHANNSTDTVDTVLEKNVTVTHSANLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSVDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5038 - protein, 566 aa, Artificial Sequence
  hemagglutinin__InfluenzaA__ADI24621
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGTINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 5039 - protein, 566 aa, Artificial Sequence
  hemagglutinin__InfluenzaA__ADI48184
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMGRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYERVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5040 - protein, 566 aa, Artificial Sequence; identical to SEQ ID NO: 3833
  hemagglutinin__InfluenzaA__ADI48186

SEQ ID NO: 5041 - protein, 566 aa, Artificial Sequence
  hemagglutinin__InfluenzaA__ADI48188
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSDIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5042 - protein, 566 aa, Artificial Sequence
  hemagglutinin__InfluenzaA__ADI48190
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 5043 - protein, 566 aa, Artificial Sequence
  hemagglutinin__InfluenzaA__ADI48192
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILTIYSTVASSLVLVVSLGAISFWMCSNGSLQCRICI

SEQ ID NO: 5044 - protein, 566 aa, Artificial Sequence
  hemagglutinin__InfluenzaA__ADI48194
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSLVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5045 - protein, 566 aa, Artificial Sequence
  hemagglutinin__InfluenzaA__ADI48196
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLDSTRIYQILAIYSTVASSLVLVVSLGAISFWMCSNGSLQCRICI

SEQ ID NO: 5046 - protein, 566 aa, Artificial Sequence; identical to SEQ ID NO: 3833
  hemagglutinin__InfluenzaA__ADI48198

SEQ ID NO: 5047 - protein, 566 aa, Artificial Sequence; identical to SEQ ID NO: 3833
  hemagglutinin__InfluenzaA__ADI48200

SEQ ID NO: 5048 - protein, 566 aa, Artificial Sequence
  hemagglutinin__InfluenzaA__ADI48202
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKISSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5049 - protein, 566 aa, Artificial Sequence
  hemagglutinin__InfluenzaA__ADI48204
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNVDAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITKKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5050 - protein, 566 aa, Artificial Sequence; identical to SEQ ID NO: 3833
  hemagglutinin__InfluenzaA__ADI48208

SEQ ID NO: 5051 - protein, 566 aa, Artificial Sequence; identical to SEQ ID NO: 3833
  hemagglutinin__InfluenzaA__ADI48210

SEQ ID NO: 5052 - protein, 566 aa, Artificial Sequence
  hemagglutinin__InfluenzaA__ADI48212
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDVWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5053 - protein, 566 aa, Artificial Sequence
  hemagglutinin__InfluenzaA__ADI48214
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLAVSLGAISFWMCSNGSLQCRICI

SEQ ID NO: 5054 - protein, 566 aa, Artificial Sequence; identical to SEQ ID NO: 5052
  hemagglutinin__InfluenzaA__ADI48216

SEQ ID NO: 5055 - protein, 566 aa, Artificial Sequence
  hemagglutinin__InfluenzaA__ADI48218
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYQDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5056 - protein, 566 aa, Artificial Sequence
  hemagglutinin__InfluenzaA__ADI48220
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFETTGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLGYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5057 - protein, 566 aa, Artificial Sequence
  hemagglutinin__InfluenzaA__ADI48622
MKAILVFLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5058 - protein, 566 aa, Artificial Sequence
  hemagglutinin__InfluenzaA__ADI48632
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGVHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5059 - protein, 566 aa, Artificial Sequence; identical to SEQ ID NO: 2911
  hemagglutinin__InfluenzaA__ADI48642

SEQ ID NO: 5060 - protein, 566 aa, Artificial Sequence; identical to SEQ ID NO: 2911
  hemagglutinin__InfluenzaA__ADI48652

SEQ ID NO: 5061 - protein, 566 aa, Artificial Sequence
  hemagglutinin__InfluenzaA__ADI48672
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYNNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5062 - protein, 566 aa, Artificial Sequence; identical to SEQ ID NO: 2669
  hemagglutinin__InfluenzaA__ADI48682

SEQ ID NO: 5063 - protein, 566 aa, Artificial Sequence; identical to SEQ ID NO: 2911
  hemagglutinin__InfluenzaA__ADI48692

SEQ ID NO: 5064 - protein, 566 aa, Artificial Sequence; identical to SEQ ID NO: 2849
  hemagglutinin__InfluenzaA__ADI48702

SEQ ID NO: 5065 - protein, 566 aa, Artificial Sequence; identical to SEQ ID NO: 2911
  hemagglutinin__InfluenzaA__ADI48712

SEQ ID NO: 5066 - protein, 566 aa, Artificial Sequence; identical to SEQ ID NO: 2911
  hemagglutinin__InfluenzaA__ADI48722

SEQ ID NO: 5067 - protein, 566 aa, Artificial Sequence; identical to SEQ ID NO: 2669
  hemagglutinin__InfluenzaA__ADI48732

SEQ ID NO: 5068 - protein, 566 aa, Artificial Sequence; identical to SEQ ID NO: 2669
  hemagglutinin__InfluenzaA__ADI48742

SEQ ID NO: 5069 - protein, 566 aa, Artificial Sequence
  hemagglutinin__InfluenzaA__ADI48752
MEAILVFLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5070 - protein, 566 aa, Artificial Sequence; identical to SEQ ID NO: 2911
  hemagglutinin__InfluenzaA__ADI48762

SEQ ID NO: 5071 - protein, 566 aa, Artificial Sequence
  hemagglutinin__InfluenzaA__ADI48772
MEAILVVLLYTFATANADTLCIGYQANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5072 - protein, 566 aa, Artificial Sequence
  hemagglutinin__InfluenzaA__ADI48782
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEESKLNREEIDGVKLESTRIYQILAIYSTVASSLVLVVSLGAISFWMCSNGSLQCRICI

SEQ ID NO: 5073 - protein, 566 aa, Artificial Sequence
  hemagglutinin__InfluenzaA__ADI48792
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYIFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5074 - protein, 566 aa, Artificial Sequence
  hemagglutinin__InfluenzaA__ADI49029
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLKNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5075 - protein, 566 aa, Artificial Sequence; identical to SEQ ID NO: 2911
  hemagglutinin__InfluenzaA__ADI49240

SEQ ID NO: 5076 - protein, 566 aa, Artificial Sequence; identical to SEQ ID NO: 2911
  hemagglutinin__InfluenzaA__ADI49260

SEQ ID NO: 5077 - protein, 566 aa, Artificial Sequence
  hemagglutinin__InfluenzaA__ADI49270
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAREIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5078 - protein, 566 aa, Artificial Sequence; identical to SEQ ID NO: 2911
  hemagglutinin__InfluenzaA__ADI49280

SEQ ID NO: 5079 - protein, 566 aa, Artificial Sequence; identical to SEQ ID NO: 2911
  hemagglutinin__InfluenzaA__ADI49312

SEQ ID NO: 5080 - protein, 566 aa, Artificial Sequence; identical to SEQ ID NO: 2911
  hemagglutinin__InfluenzaA__ADI49322

SEQ ID NO: 5081 - protein, 566 aa, Artificial Sequence; identical to SEQ ID NO: 2911
  hemagglutinin__InfluenzaA__ADI49332

SEQ ID NO: 5082 - protein, 566 aa, Artificial Sequence; identical to SEQ ID NO: 3238
  hemagglutinin__InfluenzaA__ADI49342

SEQ ID NO: 5083 - protein, 566 aa, Artificial Sequence; identical to SEQ ID NO: 2911
  hemagglutinin__InfluenzaA__ADI49352

SEQ ID NO: 5084 - protein, 566 aa, Artificial Sequence; identical to SEQ ID NO: 2669
  hemagglutinin__InfluenzaA__ADI49362

SEQ ID NO: 5085 - protein, 566 aa, Artificial Sequence; identical to SEQ ID NO: 4221
  hemagglutinin__InfluenzaA__ADI49382

SEQ ID NO: 5086 - protein, 566 aa, Artificial Sequence; identical to SEQ ID NO: 3022
  hemagglutinin__InfluenzaA__ADI49392

SEQ ID NO: 5087 - protein, 566 aa, Artificial Sequence; identical to SEQ ID NO: 2656
  hemagglutinin__InfluenzaA__ADI49717

SEQ ID NO: 5088 - protein, 566 aa, Artificial Sequence
  hemagglutinin__InfluenzaA__ADI49727
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSIIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5089 - protein, 566 aa, Artificial Sequence; identical to SEQ ID NO: 2656
  hemagglutinin__InfluenzaA__ADI49737

SEQ ID NO: 5090 - protein, 566 aa, Artificial Sequence; identical to SEQ ID NO: 2656
  hemagglutinin__InfluenzaA__ADI49747

SEQ ID NO: 5091 - protein, 566 aa, Artificial Sequence; identical to SEQ ID NO: 2656
  hemagglutinin__InfluenzaA__ADI49757

SEQ ID NO: 5092 - protein, 566 aa, Artificial Sequence; identical to SEQ ID NO: 2656
  hemagglutinin__InfluenzaA__ADI49767

SEQ ID NO: 5093 - protein, 566 aa, Artificial Sequence
  hemagglutinin__InfluenzaA__ADI49777
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5094 - protein, 566 aa, Artificial Sequence
  hemagglutinin__InfluenzaA__ADI49787
MKAILVVLLYTFATANADTLCIGYHANNSTDTVDTVLEKNVTVTHSVNLLEDKHNGKLCKLRGVAPLHLGKCNIAGWILGNPECESISTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5095 - protein, 566 aa, Artificial Sequence; identical to SEQ ID NO: 4004
  hemagglutinin__InfluenzaA__ADI49822

SEQ ID NO: 5096 - protein, 566 aa, Artificial Sequence
  hemagglutinin__InfluenzaA__ADI50027
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMKYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGHHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGIKLESTRIYQILAIYSTVASSLVLVVSLGAISFWMCSNGSLQCRICI

SEQ ID NO: 5097 - protein, 566 aa, Artificial Sequence
  hemagglutinin__InfluenzaA__ADI52834
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5098 - protein, 566 aa, Artificial Sequence
  hemagglutinin__InfluenzaA__ADI52835
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 5099 - protein, 566 aa, Artificial Sequence
  hemagglutinin__InfluenzaA__ADI52836
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQRLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 5100 - protein, 566 aa, Artificial Sequence
  hemagglutinin__InfluenzaA__ADI52837
MEAILVVLLYTFATANADTLCIGYHANNSTDTVDTVLEKNVTVTHSVNLLEVKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEANGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 5101 - protein, 566 aa, Artificial Sequence; identical to SEQ ID NO: 3467
  hemagglutinin__InfluenzaA__ADI72915

SEQ ID NO: 5102 - protein, 566 aa, Artificial Sequence; identical to SEQ ID NO: 3467
  hemagglutinin__InfluenzaA__ADI72916

SEQ ID NO: 5103 - protein, 566 aa, Artificial Sequence; identical to SEQ ID NO: 3467
  hemagglutinin__InfluenzaA__ADI72917

SEQ ID NO: 5104 - protein, 566 aa, Artificial Sequence
  hemagglutinin__InfluenzaA__ADI72918
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDRGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5105 - protein, 566 aa, Artificial Sequence; identical to SEQ ID NO: 3467
  hemagglutinin__InfluenzaA__ADI72919

SEQ ID NO: 5106 - protein, 566 aa, Artificial Sequence; identical to SEQ ID NO: 3467
  hemagglutinin__InfluenzaA__ADI72920

SEQ ID NO: 5107 - protein, 566 aa, Artificial Sequence
  hemagglutinin__InfluenzaA__ADI72921
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNALDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5108 - protein, 566 aa, Artificial Sequence; identical to SEQ ID NO: 2669
  hemagglutinin__InfluenzaA__ADI72922

SEQ ID NO: 5109 - protein, 566 aa, Artificial Sequence
  hemagglutinin__InfluenzaA__ADI72923
MKAILVVLLYTFATSNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGPGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5110 - protein, 566 aa, Artificial Sequence; identical to SEQ ID NO: 3467
  hemagglutinin__InfluenzaA__ADI72924

SEQ ID NO: 5111 - protein, 566 aa, Artificial Sequence; identical to SEQ ID NO: 2669
  hemagglutinin__InfluenzaA__ADI72925

SEQ ID NO: 5112 - protein, 566 aa, Artificial Sequence
  hemagglutinin__InfluenzaA__ADI72926
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSGYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5113 - protein, 566 aa, Artificial Sequence
  hemagglutinin__InfluenzaA__ADI72927
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIITSDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5114 - protein, 566 aa, Artificial Sequence
  hemagglutinin__InfluenzaA__ADI72928
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNRKEIDGVKLESTRIYQILAIYSTVASSLVLVVSLGAISFWMCSNGSLQCRICI

SEQ ID NO: 5115 - protein, 566 aa, Artificial Sequence; identical to SEQ ID NO: 2669
  hemagglutinin__InfluenzaA__ADI72929

SEQ ID NO: 5116 - protein, 566 aa, Artificial Sequence; identical to SEQ ID NO: 2669
  hemagglutinin__InfluenzaA__ADI72930

SEQ ID NO: 5117 - protein, 566 aa, Artificial Sequence
  hemagglutinin__InfluenzaA__ADI72931
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGIKLESTRIYQILAIYSTVASSLVLVVSLGAISFWMCSNGSLQCRICI

SEQ ID NO: 5118 - protein, 566 aa, Artificial Sequence; identical to SEQ ID NO: 4325
  hemagglutinin__InfluenzaA__ADI72932

SEQ ID NO: 5119 - protein, 565 aa, Artificial Sequence
  hemagglutinin__InfluenzaA__ADI75818
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYKNLLWLTEKNGLYPNLSKSYANNKEKEVLVLWGVHHPPSISDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5120 - protein, 565 aa, Artificial Sequence
  hemagglutinin__InfluenzaA__ADI75851
MKVKLLVLLCTFTATYADTICIGYHANNSTDTVDTVLEKNVTVTHSVNLLENSHNGKLCLLKGIAPLQLGNCSVAGWILGNPECGLLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5121 - protein, 566 aa, Artificial Sequence; identical to SEQ ID NO: 2434
  hemagglutinin__InfluenzaA__ADI75884

SEQ ID NO: 5122 - protein, 566 aa, Artificial Sequence; identical to SEQ ID NO: 2434
  hemagglutinin__InfluenzaA__ADI75917

SEQ ID NO: 5123 - protein, 565 aa, Artificial Sequence
  hemagglutinin__InfluenzaA__ADI77349
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLILWGVHHPPNMADQKTLYHTENAYVSVVSSHYSRKFTPEIAKRPKVRDQEGRINYYWTLLEPGDTIIFEANGNLIAPRYAFALSRGFGSGIINSNAPMDKCDTKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5124 - protein, 566 aa, Artificial Sequence; identical to SEQ ID NO: 2669
  hemagglutinin__InfluenzaA__ADI77360

SEQ ID NO: 5125 - protein, 566 aa, Artificial Sequence
  hemagglutinin__InfluenzaA__ADI99498
MKTILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRGQEGRMNYYWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5126 - protein, 566 aa, Artificial Sequence
  hemagglutinin__InfluenzaA__ADI99560
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCNNTCMESVKNGTYDYPKYSEEAKLNREEIDGVKLESTRIYQILAIYSTVASSLVLVVSLGAISFWMCSNGSLQCRICI

SEQ ID NO: 5127 - protein, 566 aa, Artificial Sequence; identical to SEQ ID NO: 5126
  hemagglutinin__InfluenzaA__ADI99570

SEQ ID NO: 5128 - protein, 566 aa, Artificial Sequence; identical to SEQ ID NO: 5126
  hemagglutinin__InfluenzaA__ADI99580

SEQ ID NO: 5129 - protein, 566 aa, Artificial Sequence; identical to SEQ ID NO: 4282
  hemagglutinin__InfluenzaA__ADI99590

SEQ ID NO: 5130 - protein, 566 aa, Artificial Sequence
  hemagglutinin__InfluenzaA__ADI99610
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5131 - protein, 566 aa, Artificial Sequence
  hemagglutinin__InfluenzaA__ADI99620
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIITDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5132 - protein, 566 aa, Artificial Sequence
  hemagglutinin__InfluenzaA__ADI99630
MKAILVVLLYTFATANADTLCIGYHANNSTDTVDTVLEKNVTVTHSVNLLEDKNNGKLCKLRGVAPLHLGKCNIAGWILGNPECESLSTASSWSYIVETSSSDNGTCYPGNFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5133 - protein, 566 aa, Artificial Sequence
  hemagglutinin__InfluenzaA__ADI99640
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADSYVFVGTSRYSKKFKPEIAIRPKVRDQEGRMNYYWTLVEPGDKITFEATGNLVVPRYAFAMERNAGSGIIISDTPIHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5134 - protein, 566 aa, Artificial Sequence; identical to SEQ ID NO: 4221
  hemagglutinin__InfluenzaA__ADI99660

SEQ ID NO: 5135 - protein, 566 aa, Artificial Sequence
  hemagglutinin__InfluenzaA__ADI99670
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYGYPKYSEEAKLNREEIDGVKLESTRIYQILAIYSTVASSLVLVVSLGAISFWMCSNGSLQCRICI

SEQ ID NO: 5136 - protein, 566 aa, Artificial Sequence
  hemagglutinin__InfluenzaA__ADI99680
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTIVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5137 - protein, 566 aa, Artificial Sequence
  hemagglutinin__InfluenzaA__ADI99690
MKAILAVLLYTFAIANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKKVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5138 - protein, 566 aa, Artificial Sequence
  hemagglutinin__InfluenzaA__ADI99700
MKAILVVLLYTFATANADTLCIGYHANNSTDTVDTVLEKNVTVTHSVNLLEDKHNGKLCKLRGVSPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGVHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5139 - protein, 566 aa, Artificial Sequence; identical to SEQ ID NO: 4318
  hemagglutinin__InfluenzaA__ADI99710

SEQ ID NO: 5140 - protein, 566 aa, Artificial Sequence
  hemagglutinin__InfluenzaA__ADI99720
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVSRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5141 - protein, 566 aa, Artificial Sequence; identical to SEQ ID NO: 2669
  hemagglutinin__InfluenzaA__ADI99730

SEQ ID NO: 5142 - protein, 566 aa, Artificial Sequence; identical to SEQ ID NO: 2669
  hemagglutinin__InfluenzaA__ADJ00497

SEQ ID NO: 5143 - protein, 566 aa, Artificial Sequence; identical to SEQ ID NO: 2669
  hemagglutinin__InfluenzaA__ADJ00498

SEQ ID NO: 5144 - protein, 566 aa, Artificial Sequence; identical to SEQ ID NO: 3863
  hemagglutinin__InfluenzaA__ADJ00501

SEQ ID NO: 5145 - protein, 566 aa, Artificial Sequence; identical to SEQ ID NO: 3833
  hemagglutinin__InfluenzaA__ADJ18163

SEQ ID NO: 5146 - protein, 566 aa, Artificial Sequence; identical to SEQ ID NO: 3833
  hemagglutinin__InfluenzaA__ADJ18165

SEQ ID NO: 5147 - protein, 566 aa, Artificial Sequence
  hemagglutinin__InfluenzaA__ADJ18167
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPYAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5148 - protein, 566 aa, Artificial Sequence
  hemagglutinin__InfluenzaA__ADJ18169
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5149 - protein, 566 aa, Artificial Sequence
  hemagglutinin__InfluenzaA__ADJ18171
MKAILVVLLYTFATANADTLCIGYHANNSTDTVDTVLEKNVTVTHSVNLLEDKHNGKLCKLRGVAPLHLGKCNIAGWILGNPECESLSTASSWPYIVETSSSDNGTCYPGDFIDYEELREQLSSVSSFERFEIFPKTSSWPNHDSNKGVTAACPHAGAKSFYQNLIWLVKKGNSYPKLSKSYIHDKGKEVLVLWGIHHPSTSADQQSLYQNADAYVFVGTSRYSKKFKPEIAIRPKVRDRQGRMNYYWTLVELGDKITFEATGNLVVPRYAFAMERNAGSGIIISDTPVHNCNTTCQTTTGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5150 - protein, 566 aa, Artificial Sequence; identical to SEQ ID NO: 3833
  hemagglutinin__InfluenzaA__ADJ18173

SEQ ID NO: 5151 - protein, 566 aa, Artificial Sequence; identical to SEQ ID NO: 3833
  hemagglutinin__InfluenzaA__ADJ18175

SEQ ID NO: 5152 - protein, 566 aa, Artificial Sequence
  hemagglutinin__InfluenzaA__ADJ18177
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSVQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5153 - protein, 566 aa, Artificial Sequence
  hemagglutinin__InfluenzaA__ADJ40444
MKAILVVLLYTFATANADTLCIGYHANNSTDTVDTVLKKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5154 - protein, 566 aa, Artificial Sequence
  hemagglutinin__InfluenzaA__ADJ40454
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVELESTRIYQILAIYSTVASSLVLVVSLGAISFWMCSNGSLQCRICI

SEQ ID NO: 5155 - protein, 566 aa, Artificial Sequence
  hemagglutinin__InfluenzaA__ADJ40464
MKAILVVLLYTFATANTDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLILLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5156 - protein, 566 aa, Artificial Sequence
  hemagglutinin__InfluenzaA__ADJ40474
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRRQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5157 - protein, 566 aa, Artificial Sequence
  hemagglutinin__InfluenzaA__ADJ40494
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKTLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5158 - protein, 566 aa, Artificial Sequence
  hemagglutinin__InfluenzaA__ADJ40514
MKAVLVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5159 - protein, 566 aa, Artificial Sequence; identical to SEQ ID NO: 2669
  hemagglutinin__InfluenzaA__ADJ40524

SEQ ID NO: 5160 - protein, 566 aa, Artificial Sequence; identical to SEQ ID NO: 3022
  hemagglutinin__InfluenzaA__ADJ40534

SEQ ID NO: 5161 - protein, 566 aa, Artificial Sequence
  hemagglutinin__InfluenzaA__ADJ40554
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPNTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5162 - protein, 566 aa, Artificial Sequence; identical to SEQ ID NO: 2669
  hemagglutinin__InfluenzaA__ADJ40564

SEQ ID NO: 5163 - protein, 566 aa, Artificial Sequence; identical to SEQ ID NO: 2669
  hemagglutinin__InfluenzaA__ADJ40574

SEQ ID NO: 5164 - protein, 566 aa, Artificial Sequence; identical to SEQ ID NO: 4089
  hemagglutinin__InfluenzaA__ADJ40584

SEQ ID NO: 5165 - protein, 566 aa, Artificial Sequence; identical to SEQ ID NO: 2669
  hemagglutinin__InfluenzaA__ADJ40594

SEQ ID NO: 5166 - protein, 566 aa, Artificial Sequence; identical to SEQ ID NO: 3238
  hemagglutinin__InfluenzaA__ADJ40604

SEQ ID NO: 5167 - protein, 566 aa, Artificial Sequence; identical to SEQ ID NO: 3238
  hemagglutinin__InfluenzaA__ADJ40614

SEQ ID NO: 5168 - protein, 566 aa, Artificial Sequence; identical to SEQ ID NO: 2669
  hemagglutinin__InfluenzaA__ADJ40634

SEQ ID NO: 5169 - protein, 566 aa, Artificial Sequence; identical to SEQ ID NO: 2669
  hemagglutinin__InfluenzaA__ADJ40644

SEQ ID NO: 5170 - protein, 566 aa, Artificial Sequence; identical to SEQ ID NO: 2669
  hemagglutinin__InfluenzaA__ADJ40654

SEQ ID NO: 5171 - protein, 566 aa, Artificial Sequence; identical to SEQ ID NO: 2669
  hemagglutinin__InfluenzaA__ADJ40664

SEQ ID NO: 5172 - protein, 566 aa, Artificial Sequence; identical to SEQ ID NO: 2669
  hemagglutinin__InfluenzaA__ADJ40674

SEQ ID NO: 5173 - protein, 566 aa, Artificial Sequence
  hemagglutinin__InfluenzaA__ADJ41816
MKTIIALSYMFCLVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSCTCKRGSNDSFFSRLNWLYESESKYPVLNVTMPNNGKFDKLYIWGIHHPSTDKEQTNLYIRASGRVTVSTKRSQQTVIPNIGSRPWVRGLSSRISIYWTIVKPGDILLISSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 5174 - protein, 566 aa, Artificial Sequence; identical to SEQ ID NO: 2669
  hemagglutinin__InfluenzaA__ADJ56640

SEQ ID NO: 5175 - protein, 566 aa, Artificial Sequence; identical to SEQ ID NO: 3467
  hemagglutinin__InfluenzaA__ADJ56650

SEQ ID NO: 5176 - protein, 566 aa, Artificial Sequence; identical to SEQ ID NO: 2760
  hemagglutinin__InfluenzaA__ADJ67983

SEQ ID NO: 5177 - protein, 566 aa, Artificial Sequence; identical to SEQ ID NO: 2760
  hemagglutinin__InfluenzaA__ADJ67984

SEQ ID NO: 5178 - protein, 566 aa, Artificial Sequence; identical to SEQ ID NO: 2760
  hemagglutinin__InfluenzaA__ADJ67985

SEQ ID NO: 5179 - protein, 566 aa, Artificial Sequence
  hemagglutinin__InfluenzaA__ADJ80241
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5180 - protein, 566 aa, Artificial Sequence
  hemagglutinin__InfluenzaA__ADJ80242
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5181 - protein, 566 aa, Artificial Sequence; identical to SEQ ID NO: 4221
  hemagglutinin__InfluenzaA__ADJ80243

SEQ ID NO: 5182 - protein, 566 aa, Artificial Sequence; identical to SEQ ID NO: 2669
  hemagglutinin__InfluenzaA__ADJ80634

SEQ ID NO: 5183 - protein, 566 aa, Artificial Sequence; identical to SEQ ID NO: 4671
  hemagglutinin__InfluenzaA__ADJ80644

SEQ ID NO: 5184 - protein, 566 aa, Artificial Sequence; identical to SEQ ID NO: 4671
  hemagglutinin__InfluenzaA__ADJ80654

SEQ ID NO: 5185 - protein, 566 aa, Artificial Sequence; identical to SEQ ID NO: 3833
  hemagglutinin__InfluenzaA__ADJ80674

SEQ ID NO: 5186 - protein, 566 aa, Artificial Sequence; identical to SEQ ID NO: 3833
  hemagglutinin__InfluenzaA__ADJ80684

SEQ ID NO: 5187 - protein, 566 aa, Artificial Sequence
  hemagglutinin__InfluenzaA__ADJ80694
MKAILVVLLYTFATANADTLCIGYHANNSTDTVDTVLEKNVTVTHSVNILEDNHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5188 - protein, 566 aa, Artificial Sequence; identical to SEQ ID NO: 3833
  hemagglutinin__InfluenzaA__ADJ80704

SEQ ID NO: 5189 - protein, 566 aa, Artificial Sequence
  hemagglutinin__InfluenzaA__ADJ80714
MKAILVVLLYTFATANADTLCIGYHANNSTDTVDTVLEKNVTVTHSVNLLEDKHNGKLCKLRGAAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5190 - protein, 566 aa, Artificial Sequence; identical to SEQ ID NO: 2669
  hemagglutinin__InfluenzaA__ADJ80724

SEQ ID NO: 5191 - protein, 566 aa, Artificial Sequence; identical to SEQ ID NO: 3833
  hemagglutinin__InfluenzaA__ADJ80734

SEQ ID NO: 5192 - protein, 566 aa, Artificial Sequence; identical to SEQ ID NO: 3833
  hemagglutinin__InfluenzaA__ADJ80744

SEQ ID NO: 5193 - protein, 566 aa, Artificial Sequence; identical to SEQ ID NO: 3833
  hemagglutinin__InfluenzaA__ADJ80754

SEQ ID NO: 5194 - protein, 566 aa, Artificial Sequence
  hemagglutinin__InfluenzaA__ADJ80774
MKAILVVLLYTFATANADTLCIGYHANNSTDTVDTVLEKNVTVTHSVNILEDKHNGKLCKLRGVAPLHLGKCNIAGWILGNPECESLSTANSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5195 - protein, 566 aa, Artificial Sequence
  hemagglutinin__InfluenzaA__ADJ80784
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5196 - protein, 566 aa, Artificial Sequence; identical to SEQ ID NO: 3833
  hemagglutinin__InfluenzaA__ADJ80794

SEQ ID NO: 5197 - protein, 566 aa, Artificial Sequence; identical to SEQ ID NO: 4671
  hemagglutinin__InfluenzaA__ADJ80804

SEQ ID NO: 5198 - protein, 566 aa, Artificial Sequence
  hemagglutinin__InfluenzaA__ADJ80814
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPRAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAIERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5199 - protein, 566 aa, Artificial Sequence
  hemagglutinin__InfluenzaA__ADJ80834
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNSGSGIIISDTPVHYCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5200 - protein, 566 aa, Artificial Sequence; identical to SEQ ID NO: 4871
  hemagglutinin__InfluenzaA__ADJ80848

SEQ ID NO: 5201 - protein, 566 aa, Artificial Sequence
  hemagglutinin__InfluenzaA__ADJ80858
MKTILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5202 - protein, 566 aa, Artificial Sequence
  hemagglutinin__InfluenzaA__ADJ80868
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPNAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGGKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5203 - protein, 566 aa, Artificial Sequence; identical to SEQ ID NO: 3833
  hemagglutinin__InfluenzaA__ADJ80883

SEQ ID NO: 5204 - protein, 566 aa, Artificial Sequence; identical to SEQ ID NO: 3833
  hemagglutinin__InfluenzaA__ADJ80893

SEQ ID NO: 5205 - protein, 566 aa, Artificial Sequence; identical to SEQ ID NO: 3833
  hemagglutinin__InfluenzaA__ADJ80910

SEQ ID NO: 5206 - protein, 566 aa, Artificial Sequence; identical to SEQ ID NO: 2669
  hemagglutinin__InfluenzaA__ADJ80927

SEQ ID NO: 5207 - protein, 566 aa, Artificial Sequence
  hemagglutinin__InfluenzaA__ADJ80937
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKSLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5208 - protein, 566 aa, Artificial Sequence; identical to SEQ ID NO: 3833
  hemagglutinin__InfluenzaA__ADJ80947

SEQ ID NO: 5209 - protein, 566 aa, Artificial Sequence; identical to SEQ ID NO: 3833
  hemagglutinin__InfluenzaA__ADJ80967

SEQ ID NO: 5210 - protein, 566 aa, Artificial Sequence; identical to SEQ ID NO: 3833
  hemagglutinin__InfluenzaA__ADJ80977

SEQ ID NO: 5211 - protein, 566 aa, Artificial Sequence
  hemagglutinin__InfluenzaA__ADJ80993
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPNAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5212 - protein, 566 aa, Artificial Sequence
  hemagglutinin__InfluenzaA__ADJ81003
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 5213 - protein, 566 aa, Artificial Sequence; identical to SEQ ID NO: 4871
  hemagglutinin__InfluenzaA__ADJ81013

SEQ ID NO: 5214 - protein, 566 aa, Artificial Sequence
  hemagglutinin__InfluenzaA__ADJ81023
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5215 - protein, 566 aa, Artificial Sequence; identical to SEQ ID NO: 3833
  hemagglutinin__InfluenzaA__ADJ81033

SEQ ID NO: 5216 - protein, 566 aa, Artificial Sequence; identical to SEQ ID NO: 2669
  hemagglutinin__InfluenzaA__ADJ81043

SEQ ID NO: 5217 - protein, 566 aa, Artificial Sequence
  hemagglutinin__InfluenzaA__ADJ81053
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5218 - protein, 566 aa, Artificial Sequence; identical to SEQ ID NO: 3833
  hemagglutinin__InfluenzaA__ADJ81063

SEQ ID NO: 5219 - protein, 566 aa, Artificial Sequence; identical to SEQ ID NO: 3613
  hemagglutinin__InfluenzaA__ADJ84772

SEQ ID NO: 5220 - protein, 566 aa, Artificial Sequence
  hemagglutinin__InfluenzaA__ADJ88782
MKTIIALSYMLCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLGENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5221 - protein, 566 aa, Artificial Sequence
  hemagglutinin__InfluenzaA__ADK21733
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5222 - protein, 566 aa, Artificial Sequence
  hemagglutinin__InfluenzaA__ADK21743
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKISNSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5223 - protein, 566 aa, Artificial Sequence
  hemagglutinin__InfluenzaA__ADK21753
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEGNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5224 - protein, 566 aa, Artificial Sequence
  hemagglutinin__InfluenzaA__ADK21763
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5225 - protein, 566 aa, Artificial Sequence; identical to SEQ ID NO: 3833
  hemagglutinin__InfluenzaA__ADK21773

SEQ ID NO: 5226 - protein, 566 aa, Artificial Sequence; identical to SEQ ID NO: 3833
  hemagglutinin__InfluenzaA__ADK21783

SEQ ID NO: 5227 - protein, 566 aa, Artificial Sequence; identical to SEQ ID NO: 2669
  hemagglutinin__InfluenzaA__ADK21813

SEQ ID NO: 5228 - protein, 566 aa, Artificial Sequence; identical to SEQ ID NO: 4089
  hemagglutinin__InfluenzaA__ADK21823

SEQ ID NO: 5229 - protein, 566 aa, Artificial Sequence
  hemagglutinin__InfluenzaA__ADK21833
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVRDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5230 - protein, 566 aa, Artificial Sequence; identical to SEQ ID NO: 3833
  hemagglutinin__InfluenzaA__ADK21843

SEQ ID NO: 5231 - protein, 566 aa, Artificial Sequence; identical to SEQ ID NO: 3022
  hemagglutinin__InfluenzaA__ADK21853

SEQ ID NO: 5232 - protein, 566 aa, Artificial Sequence; identical to SEQ ID NO: 4318
  hemagglutinin__InfluenzaA__ADK21863

SEQ ID NO: 5233 - protein, 566 aa, Artificial Sequence; identical to SEQ ID NO: 3116
  hemagglutinin__InfluenzaA__ADK21873

SEQ ID NO: 5234 - protein, 566 aa, Artificial Sequence
  hemagglutinin__InfluenzaA__ADK21883
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPKYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5235 - protein, 566 aa, Artificial Sequence; identical to SEQ ID NO: 2669
  hemagglutinin__InfluenzaA__ADK21893

SEQ ID NO: 5236 - protein, 566 aa, Artificial Sequence; identical to SEQ ID NO: 4266
  hemagglutinin__InfluenzaA__ADK21903

SEQ ID NO: 5237 - protein, 566 aa, Artificial Sequence; identical to SEQ ID NO: 4379
  hemagglutinin__InfluenzaA__ADK21913

SEQ ID NO: 5238 - protein, 566 aa, Artificial Sequence
  hemagglutinin__InfluenzaA__ADK21923
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKARSQLKNNAKEIGNGCFEFYHKCDNTCMESVKNGTYDYPKYSEEAKLNREKIDGVKLESTRIYQILAIYSTVASTLVLVVSLGAISFWMCSNGSLQCRICI

SEQ ID NO: 5239 - protein, 566 aa, Artificial Sequence
  hemagglutinin__InfluenzaA__ADK21933
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPNAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5240 - protein, 566 aa, Artificial Sequence; identical to SEQ ID NO: 2669
  hemagglutinin__InfluenzaA__ADK21943

SEQ ID NO: 5241 - protein, 566 aa, Artificial Sequence
  hemagglutinin__InfluenzaA__ADK21953
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDHEELREQLSSVSSFERFEIFPKTSSWPNHDSNKGVTAACPHAGAKSFYKNLIWLVKKGNSYPKLSKSYINDKGKEVLVLWAIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5242 - protein, 566 aa, Artificial Sequence; identical to SEQ ID NO: 4856
  hemagglutinin__InfluenzaA__ADK32390

SEQ ID NO: 5243 - protein, 566 aa, Artificial Sequence; identical to SEQ ID NO: 4856
  hemagglutinin__InfluenzaA__ADK32400

SEQ ID NO: 5244 - protein, 566 aa, Artificial Sequence
  hemagglutinin__InfluenzaA__ADK32420
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5245 - protein, 566 aa, Artificial Sequence; identical to SEQ ID NO: 4221
  hemagglutinin__InfluenzaA__ADK32430

SEQ ID NO: 5246 - protein, 566 aa, Artificial Sequence
  hemagglutinin__InfluenzaA__ADK32440
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5247 - protein, 566 aa, Artificial Sequence
  hemagglutinin__InfluenzaA__ADK32450
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDAPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5248 - protein, 566 aa, Artificial Sequence
  hemagglutinin__InfluenzaA__ADK32460
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5249 - protein, 566 aa, Artificial Sequence; identical to SEQ ID NO: 3833
  hemagglutinin__InfluenzaA__ADK32470

SEQ ID NO: 5250 - protein, 566 aa, Artificial Sequence
  hemagglutinin__InfluenzaA__ADK32480
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5251 - protein, 566 aa, Artificial Sequence; identical to SEQ ID NO: 3833
  hemagglutinin__InfluenzaA__ADK32490

SEQ ID NO: 5252 - protein, 566 aa, Artificial Sequence; identical to SEQ ID NO: 3833
  hemagglutinin__InfluenzaA__ADK32502

SEQ ID NO: 5253 - protein, 566 aa, Artificial Sequence; identical to SEQ ID NO: 4305
  hemagglutinin__InfluenzaA__ADK32637

SEQ ID NO: 5254 - protein, 566 aa, Artificial Sequence; identical to SEQ ID NO: 3833
  hemagglutinin__InfluenzaA__ADK32647

SEQ ID NO: 5255 - protein, 566 aa, Artificial Sequence; identical to SEQ ID NO: 3997
  hemagglutinin__InfluenzaA__ADK32657

SEQ ID NO: 5256 - protein, 566 aa, Artificial Sequence; identical to SEQ ID NO: 4221
  hemagglutinin__InfluenzaA__ADK32677

SEQ ID NO: 5257 - protein, 566 aa, Artificial Sequence
  hemagglutinin__InfluenzaA__ADK32687
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKNFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5258 - protein, 566 aa, Artificial Sequence; identical to SEQ ID NO: 4460
  hemagglutinin__InfluenzaA__ADK32697

SEQ ID NO: 5259 - protein, 566 aa, Artificial Sequence; identical to SEQ ID NO: 3833
  hemagglutinin__InfluenzaA__ADK32776

SEQ ID NO: 5260 - protein, 566 aa, Artificial Sequence; identical to SEQ ID NO: 4221
  hemagglutinin__InfluenzaA__ADK33621

SEQ ID NO: 5261 - protein, 566 aa, Artificial Sequence
  hemagglutinin__InfluenzaA__ADK33631
MKAILVVLLYTFATANADTLCIGYHANNSTDTVDTVLEKNVTVTHSVNLLEVKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5262 - protein, 566 aa, Artificial Sequence; identical to SEQ ID NO: 4221
  hemagglutinin__InfluenzaA__ADK33641

SEQ ID NO: 5263 - protein, 566 aa, Artificial Sequence; identical to SEQ ID NO: 3833
  hemagglutinin__InfluenzaA__ADK33651

SEQ ID NO: 5264 - protein, 566 aa, Artificial Sequence; identical to SEQ ID NO: 3833
  hemagglutinin__InfluenzaA__ADK33661

SEQ ID NO: 5265 - protein, 566 aa, Artificial Sequence; identical to SEQ ID NO: 3833
  hemagglutinin__InfluenzaA__ADK33671

SEQ ID NO: 5266 - protein, 566 aa, Artificial Sequence
  hemagglutinin__InfluenzaA__ADK33681
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5267 - protein, 566 aa, Artificial Sequence; identical to SEQ ID NO: 4282
  hemagglutinin__InfluenzaA__ADK33691

SEQ ID NO: 5268 - protein, 566 aa, Artificial Sequence
  hemagglutinin__InfluenzaA__ADK33701
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 5269 - protein, 566 aa, Artificial Sequence
  hemagglutinin__InfluenzaA__ADK33711
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5270 - protein, 566 aa, Artificial Sequence
  hemagglutinin__InfluenzaA__ADK33721
MKAILVVLLYTFVTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5271 - protein, 566 aa, Artificial Sequence
  hemagglutinin__InfluenzaA__ADK33731
MKATLVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYAFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5272 - protein, 566 aa, Artificial Sequence; identical to SEQ ID NO: 4836
  hemagglutinin__InfluenzaA__ADK33741

SEQ ID NO: 5273 - protein, 566 aa, Artificial Sequence; identical to SEQ ID NO: 2669
  hemagglutinin__InfluenzaA__ADK33751

SEQ ID NO: 5274 - protein, 566 aa, Artificial Sequence
  hemagglutinin__InfluenzaA__ADK33761
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLSLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5275 - protein, 566 aa, Artificial Sequence; identical to SEQ ID NO: 3833
  hemagglutinin__InfluenzaA__ADK33771

SEQ ID NO: 5276 - protein, 566 aa, Artificial Sequence; identical to SEQ ID NO: 3833
  hemagglutinin__InfluenzaA__ADK33781

SEQ ID NO: 5277 - protein, 566 aa, Artificial Sequence; identical to SEQ ID NO: 3770
  hemagglutinin__InfluenzaA__ADK33791

SEQ ID NO: 5278 - protein, 566 aa, Artificial Sequence; identical to SEQ ID NO: 5268
  hemagglutinin__InfluenzaA__ADK33801

SEQ ID NO: 5279 - protein, 566 aa, Artificial Sequence
  hemagglutinin__InfluenzaA__ADK33811
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGIKLESTRIYQILAIYSTVASSLVLVVSLGAISFWMCSNGSLQCRICI

SEQ ID NO: 5280 - protein, 566 aa, Artificial Sequence
  hemagglutinin__InfluenzaA__ADK33821
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLAVSLGAISFWMCSNGSLQCRICI

SEQ ID NO: 5281 - protein, 566 aa, Artificial Sequence
  hemagglutinin__InfluenzaA__ADK33831
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPNTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5282 - protein, 566 aa, Artificial Sequence; identical to SEQ ID NO: 4089
  hemagglutinin__InfluenzaA__ADK33841

SEQ ID NO: 5283 - protein, 566 aa, Artificial Sequence; identical to SEQ ID NO: 4836
  hemagglutinin__InfluenzaA__ADK33851

SEQ ID NO: 5284 - protein, 566 aa, Artificial Sequence; identical to SEQ ID NO: 2669
  hemagglutinin__InfluenzaA__ADK33861

SEQ ID NO: 5285 - protein, 566 aa, Artificial Sequence
  hemagglutinin__InfluenzaA__ADK33871
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVIPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLLVSLGAISFWMCSNGSLQCRICI

SEQ ID NO: 5286 - protein, 566 aa, Artificial Sequence
  hemagglutinin__InfluenzaA__ADK33881
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTKIYQILAIYSTVASSLVLVVSLGAISFWMCSNGSLQCRICI

SEQ ID NO: 5287 - protein, 566 aa, Artificial Sequence
  hemagglutinin__InfluenzaA__ADK33891
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5288 - protein, 566 aa, Artificial Sequence; identical to SEQ ID NO: 4836
  hemagglutinin__InfluenzaA__ADK33901

SEQ ID NO: 5289 - protein, 566 aa, Artificial Sequence
  hemagglutinin__InfluenzaA__ADK33911
MKAILVVLLYTFATANADTLCIGYHANNSTDTVDTVLEKNVTVTHSVNLLEGKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLIKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5290 - protein, 566 aa, Artificial Sequence
  hemagglutinin__InfluenzaA__ADK33931
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLLVSLGAISFWMCSNGSLQCRICI

SEQ ID NO: 5291 - protein, 566 aa, Artificial Sequence
  hemagglutinin__InfluenzaA__ADK33941
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5292 - protein, 566 aa, Artificial Sequence; identical to SEQ ID NO: 5289
  hemagglutinin__InfluenzaA__ADK33951

SEQ ID NO: 5293 - protein, 566 aa, Artificial Sequence; identical to SEQ ID NO: 3833
  hemagglutinin__InfluenzaA__ADK33961

SEQ ID NO: 5294 - protein, 566 aa, Artificial Sequence; identical to SEQ ID NO: 3613
  hemagglutinin__InfluenzaA__ADK45312

SEQ ID NO: 5295 - protein, 566 aa, Artificial Sequence
  hemagglutinin__InfluenzaA__ADK45410
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNTCIGSIRNGTYDHDVYRDEALNNRFQIKGVELKSGYKDWILWISFAISCFLLCVALLGFIMWACQKGNIRCNICI

SEQ ID NO: 5296 - protein, 566 aa, Artificial Sequence
  hemagglutinin__InfluenzaA__ADK45421
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5297 - protein, 566 aa, Artificial Sequence
  hemagglutinin__InfluenzaA__ADK45432
MKTIIALSYTLCLVFAQKLPRNDNSTATLCLGHHAVPNGTIVKTITNDQIEVTNATELVQSSSTGEICDNPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5298 - protein, 566 aa, Artificial Sequence; identical to SEQ ID NO: 2434
  hemagglutinin__InfluenzaA__ADK45443

SEQ ID NO: 5299 - protein, 566 aa, Artificial Sequence; identical to SEQ ID NO: 4833
  hemagglutinin__InfluenzaA__ADK48798

SEQ ID NO: 5300 - protein, 566 aa, Artificial Sequence; identical to SEQ ID NO: 3833
  hemagglutinin__InfluenzaA__ADK62683

SEQ ID NO: 5301 - protein, 566 aa, Artificial Sequence
  hemagglutinin__InfluenzaA__ADK62693
MKAILVVLLYTFATANADTLCIGYHANNSTDTVDTVLEKNVTVTHSVNLLEDKHNGKLCKLRGVAPLHLGKCNIAGWILGNPECGSLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5302 - protein, 566 aa, Artificial Sequence; identical to SEQ ID NO: 3770
  hemagglutinin__InfluenzaA__ADK62703

SEQ ID NO: 5303 - protein, 566 aa, Artificial Sequence
  hemagglutinin__InfluenzaA__ADK64992
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGIKLESTRIYQILAIYSTVASSLVLVVSLGAISFWMCSNGSLQYRICI

SEQ ID NO: 5304 - protein, 566 aa, Artificial Sequence
  hemagglutinin__InfluenzaA__ADK65001
MKAILVVLLYTFATANADTLCIGYHANNSTDTVDTVLEKNVTVTHSVNLLEDKHNGKLCKLGGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCLESVKNGTYDYPKYSEEAKLNREEIDGVKLESTRIYQILAIYSTVASSLVLVVSLGAISFWMCSNGSLQCRICI

SEQ ID NO: 5305 - protein, 566 aa, Artificial Sequence
  hemagglutinin__InfluenzaA__ADK65009
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFGATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5306 - protein, 566 aa, Artificial Sequence
  hemagglutinin__InfluenzaA__ADK87287
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDALIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5307 - protein, 566 aa, Artificial Sequence
  hemagglutinin__InfluenzaA__ADK87288
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQATGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5308 - protein, 566 aa, Artificial Sequence
  hemagglutinin__InfluenzaA__ADK87289
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLGFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLGKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5309 - protein, 566 aa, Artificial Sequence
  hemagglutinin__InfluenzaA__ADK87291
MKTIIALSYIQCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQISLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLGKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5310 - protein, 566 aa, Artificial Sequence
  hemagglutinin__InfluenzaA__ADK87293
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQDGTSSACIRRSKNSFFSKLNWLTHLNFKYPALNVTMPNNEQFDKLYIWGVHHPGTDKDQTFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMSKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5311 - protein, 566 aa, Artificial Sequence
  hemagglutinin__InfluenzaA__ADK87295
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGSLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRRNICI

SEQ ID NO: 5312 - protein, 566 aa, Artificial Sequence
  hemagglutinin__InfluenzaA__ADK87296
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRCAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5313 - protein, 566 aa, Artificial Sequence
  hemagglutinin__InfluenzaA__ADK87298
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDSGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGNIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNPVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5314 - protein, 566 aa, Artificial Sequence
  hemagglutinin__InfluenzaA__ADK87300
MKTIIALSYILCMVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSLFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECIAPNGSIPNDKSFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5315 - protein, 566 aa, Artificial Sequence
  hemagglutinin__InfluenzaA__ADK87302
MKTIIALSYILCMVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 5316 - protein, 566 aa, Artificial Sequence
  hemagglutinin__InfluenzaA__ADK87304
MKTIIALSYILCLVFAQKIPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSGCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYGHDVYRDEALNNRFQIKGVELKSGYKDWFLWISFAISCFLLCVALLGFIMWACQKGNIRCNICI

SEQ ID NO: 5317 - protein, 566 aa, Artificial Sequence
  hemagglutinin__InfluenzaA__ADK87306
MKTIIALSYILCLVFAQKLPGNDNSTATLCLGHHAVPNGTIVKTITNDQIEVTNAAELVQSSSTGEICDSPHQILDGKNCTLIDALLGDPQCDGFQNKKWDLFVGRSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGVRNVPEKQTRGIFGAIAGFIENGWEGMVDGWYGFRHQNSEGRGQAADLKSTQAAMDQINGKLNRLIGKTNEKLHQTEKEFSEVEGRIQDLEKYVEDTKIDLWSYNAELLVALESQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5318 - protein, 566 aa, Artificial Sequence
  hemagglutinin__InfluenzaA__ADK87308
MKTIIALSYILCMVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLRVALLGFIMWACQKGNIRCNICI

SEQ ID NO: 5319 - protein, 566 aa, Artificial Sequence
  hemagglutinin__InfluenzaA__ADK87309
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALSGFIMWACQKGNIRCNICI

SEQ ID NO: 5320 - protein, 566 aa, Artificial Sequence
  hemagglutinin__InfluenzaA__ADK87310
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTGSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5321 - protein, 566 aa, Artificial Sequence
  hemagglutinin__InfluenzaA__ADK87311
MKAILVVLLYTFATANADTLCIGYHADNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSAGQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSPPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5322 - protein, 566 aa, Artificial Sequence
  hemagglutinin__InfluenzaA__ADK87313
MKTIIALSYILCLVFAQKIPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRIAVSTKRSQQTAIPNIGSRPRVRNIPSRISIYWTIVKPGDILLINSTGNLIAPRGYFKIRSGKSSIMRSDAPIGKCNSGCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWFLWISFAISCFLLCVALLGFIMWACQKGNIRCNICI

SEQ ID NO: 5323 - protein, 566 aa, Artificial Sequence
  hemagglutinin__InfluenzaA__ADK87315
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSPWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKESNHLETRIENLNKKVDDGFLDIWTYNAELLVLLENERTLDYHDSNVKNLYEKVRSQLKNNAKEIGNGCFEFYHKCDSTCMESVKNGTYDYPKYSEEAKLNREEIDGVKLESTRIYQILAIYSTVASSLVLVVSLGAISFWMCSNGSLQCRICI

SEQ ID NO: 5324 - protein, 566 aa, Artificial Sequence; identical to SEQ ID NO: 3467
  hemagglutinin__InfluenzaA__ADK87317

SEQ ID NO: 5325 - protein, 566 aa, Artificial Sequence
  hemagglutinin__InfluenzaA__ADK87319
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTELRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYRILAIYSTVASSLVLVVSLGAISFWMCSNGSLQCRICI

SEQ ID NO: 5326 - protein, 566 aa, Artificial Sequence
  hemagglutinin__InfluenzaA__ADK87321
MKTIIALSYILCLVFAQKIPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACMRRSKNSFFSRLNWLTHLNFKYPALNVTMPNNEQFDKLYIWGVHHPGTDKDQIFLYAQASGRITVSTKRSQQTAIPNIGSRPRVRNIPSRISVYWTIVKPGDILLINSTGNLIAPRGYFKIRSGKSSIMRSDASIGKCNSGCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFPEVEGRIQDLEKYVEDTKIDLWSYNAEPLVALENQHTIDLTDSEMNKLFEKTKKQLRENAEDMGNGCFKIYHKCDNACIGSIRNGTYDHDVYRDEALNNRFQIKGVELKSGYKDWFLWISFAISCFLLCVALLGFIMWACQKGNIRCNICI

SEQ ID NO: 5327 - protein, 566 aa, Artificial Sequence
  hemagglutinin__InfluenzaA__ADK87323
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVGNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5328 - protein, 566 aa, Artificial Sequence
  hemagglutinin__InfluenzaA__ADK87325
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRHVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5329 - protein, 566 aa, Artificial Sequence
  hemagglutinin__InfluenzaA__ADK87326
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGCKDWILWISFAISCFLLCVALLGFTMWACQKGNIRCNICI

SEQ ID NO: 5330 - protein, 566 aa, Artificial Sequence
  hemagglutinin__InfluenzaA__ADK87328
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKSAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5331 - protein, 566 aa, Artificial Sequence
  hemagglutinin__InfluenzaA__ADK87334
MKTIIALSYILCLVFAQKLPGNDNSTATLCLGHHAVPNGTIVKTITSDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSKLNWLTHLNFKYPALNVTMPNNEQFDKLYIWGVRHPGTDKDQIFLYAQASGRITVSTKRSQQTVIPNIGSRPRVRNIPSRISTYWTIVKPGDILLINSTGNLIAPRGYFKIRSGKSSIMRSDTPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5332 - protein, 566 aa, Artificial Sequence
  hemagglutinin__InfluenzaA__ADK87336
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSKLNWLTHLNFKYPALNVTMPNNEQFDKLYIWGVHHPGTDRDQIFLYAQASGRITVSTKRSQQTVIPNIGSRPRVRNIPSRISIYWTIVKPGDILLINSTGNLIAPRGYFKIRSGKSSIMRSDTPIGKSNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLREDAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5333 - protein, 566 aa, Artificial Sequence; identical to SEQ ID NO: 2669
  hemagglutinin__InfluenzaA__ADK87338

SEQ ID NO: 5334 - protein, 566 aa, Artificial Sequence
  hemagglutinin__InfluenzaA__ADK90193
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKVVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5335 - protein, 566 aa, Artificial Sequence
  hemagglutinin__InfluenzaA__ADK90194
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5336 - protein, 566 aa, Artificial Sequence
  hemagglutinin__InfluenzaA__ADK90195
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5337 - protein, 566 aa, Artificial Sequence; identical to SEQ ID NO: 2656
  hemagglutinin__InfluenzaA__ADK90196

SEQ ID NO: 5338 - protein, 566 aa, Artificial Sequence
  hemagglutinin__InfluenzaA__ADK90197
MRAILGVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5339 - protein, 566 aa, Artificial Sequence
  hemagglutinin__InfluenzaA__ADK90198
MKAILGVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5340 - protein, 566 aa, Artificial Sequence; identical to SEQ ID NO: 2669
  hemagglutinin__InfluenzaA__ADK90199

SEQ ID NO: 5341 - protein, 566 aa, Artificial Sequence
  hemagglutinin__InfluenzaA__ADK90200
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKIAFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAVYSTVASSLVLVVSLGAISFWMCSNGSLQCRICI

SEQ ID NO: 5342 - protein, 566 aa, Artificial Sequence
  hemagglutinin__InfluenzaA__ADK90201
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAVRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5343 - protein, 566 aa, Artificial Sequence
  hemagglutinin__InfluenzaA__ADK90202
MKAILVVLLYTFATANADTLCIGYHANNSTDTVDTVLEKNVTVTHSVNLLEDKHNGKLCKLRGVAPLHLGKCNIAGWILGNPECEPLSTASSWSYIVETSSSDNGTCYPGDFIDYEELREQLSSVSSFERLEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5344 - protein, 566 aa, Artificial Sequence; identical to SEQ ID NO: 2849
  hemagglutinin__InfluenzaA__ADK90203

SEQ ID NO: 5345 - protein, 566 aa, Artificial Sequence; identical to SEQ ID NO: 3770
  hemagglutinin__InfluenzaA__ADK90204

SEQ ID NO: 5346 - protein, 566 aa, Artificial Sequence
  hemagglutinin__InfluenzaA__ADK94191
MKTIIALSYILCLVFAQKLPGNDNSTATLCLGHHAVPNGTVVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRVSIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5347 - protein, 566 aa, Artificial Sequence
  hemagglutinin__InfluenzaA__ADK94202
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5348 - protein, 566 aa, Artificial Sequence; identical to SEQ ID NO: 2434
  hemagglutinin__InfluenzaA__ADK94213

SEQ ID NO: 5349 - protein, 566 aa, Artificial Sequence; identical to SEQ ID NO: 3613
  hemagglutinin__InfluenzaA__ADK94224

SEQ ID NO: 5350 - protein, 566 aa, Artificial Sequence
  hemagglutinin__InfluenzaA__ADK94257
METIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5351 - protein, 566 aa, Artificial Sequence
  hemagglutinin__InfluenzaA__ADK94268
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5352 - protein, 566 aa, Artificial Sequence
  hemagglutinin__InfluenzaA__ADK94279
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5353 - protein, 566 aa, Artificial Sequence; identical to SEQ ID NO: 3613
  hemagglutinin__InfluenzaA__ADK94290

SEQ ID NO: 5354 - protein, 566 aa, Artificial Sequence; identical to SEQ ID NO: 3613
  hemagglutinin__InfluenzaA__ADK94301

SEQ ID NO: 5355 - protein, 566 aa, Artificial Sequence
  hemagglutinin__InfluenzaA__ADK94323
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5356 - protein, 566 aa, Artificial Sequence; identical to SEQ ID NO: 5346
  hemagglutinin__InfluenzaA__ADK94441

SEQ ID NO: 5357 - protein, 566 aa, Artificial Sequence
  hemagglutinin__InfluenzaA__ADK94476
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAHSNCYPYDVPDYASLRSLVASSGTLEFNNESFNWTGVTQNGTSSACIRRSKNSFFSRLNWLTHLNFKYPALNVTMPNNEQFDKLYIWGAHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5358 - protein, 566 aa, Artificial Sequence; identical to SEQ ID NO: 3613
  hemagglutinin__InfluenzaA__ADK94487

SEQ ID NO: 5359 - protein, 566 aa, Artificial Sequence
  hemagglutinin__InfluenzaA__ADK94498
MKTIIALSYILCLVFAQKLPGNDNSTATLCLGHHAVPNGTVVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 5360 - protein, 566 aa, Artificial Sequence
  hemagglutinin__InfluenzaA__ADK94509
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5361 - protein, 566 aa, Artificial Sequence
  hemagglutinin__InfluenzaA__ADK94520
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIKCNICI

SEQ ID NO: 5362 - protein, 566 aa, Artificial Sequence; identical to SEQ ID NO: 3613
  hemagglutinin__InfluenzaA__ADK94531

SEQ ID NO: 5363 - protein, 566 aa, Artificial Sequence; identical to SEQ ID NO: 2434
  hemagglutinin__InfluenzaA__ADK94542

SEQ ID NO: 5364 - protein, 566 aa, Artificial Sequence
  hemagglutinin__InfluenzaA__ADK94553
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCNNACIGSIRNGTYDHDVYRDEALNNRFQIKGVELKSGYKDWILWISFAISCFLLCVALLGFIMWACQKGNIRCNICI

SEQ ID NO: 5365 - protein, 566 aa, Artificial Sequence; identical to SEQ ID NO: 3613
  hemagglutinin__InfluenzaA__ADK94564

SEQ ID NO: 5366 - protein, 566 aa, Artificial Sequence
  hemagglutinin__InfluenzaA__ADK98501
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFETTGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5367 - protein, 566 aa, Artificial Sequence
  hemagglutinin__InfluenzaA__ADK98503
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNVDAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5368 - protein, 566 aa, Artificial Sequence; identical to SEQ ID NO: 5351
  hemagglutinin__InfluenzaA__ADK98623

SEQ ID NO: 5369 - protein, 566 aa, Artificial Sequence; identical to SEQ ID NO: 2434
  hemagglutinin__InfluenzaA__ADK98634

SEQ ID NO: 5370 - protein, 566 aa, Artificial Sequence; identical to SEQ ID NO: 2434
  hemagglutinin__InfluenzaA__ADK98645

SEQ ID NO: 5371 - protein, 566 aa, Artificial Sequence; identical to SEQ ID NO: 5297
  hemagglutinin__InfluenzaA__ADK98656

SEQ ID NO: 5372 - protein, 566 aa, Artificial Sequence; identical to SEQ ID NO: 5364
  hemagglutinin__InfluenzaA__ADK98667

SEQ ID NO: 5373 - protein, 566 aa, Artificial Sequence
  hemagglutinin__InfluenzaA__ADK98678
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITQNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5374 - protein, 566 aa, Artificial Sequence; identical to SEQ ID NO: 2434
  hemagglutinin__InfluenzaA__ADK98689

SEQ ID NO: 5375 - protein, 566 aa, Artificial Sequence; identical to SEQ ID NO: 2434
  hemagglutinin__InfluenzaA__ADK98700

SEQ ID NO: 5376 - protein, 566 aa, Artificial Sequence; identical to SEQ ID NO: 2434
  hemagglutinin__InfluenzaA__ADK98711

SEQ ID NO: 5377 - protein, 566 aa, Artificial Sequence
  hemagglutinin__InfluenzaA__ADK98722
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKGSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5378 - protein, 566 aa, Artificial Sequence; identical to SEQ ID NO: 5351
  hemagglutinin__InfluenzaA__ADK98733

SEQ ID NO: 5379 - protein, 566 aa, Artificial Sequence; identical to SEQ ID NO: 2434
  hemagglutinin__InfluenzaA__ADK98744

SEQ ID NO: 5380 - protein, 566 aa, Artificial Sequence; identical to SEQ ID NO: 2434
  hemagglutinin__InfluenzaA__ADK98777

SEQ ID NO: 5381 - protein, 566 aa, Artificial Sequence; identical to SEQ ID NO: 2434
  hemagglutinin__InfluenzaA__ADK98788

SEQ ID NO: 5382 - protein, 566 aa, Artificial Sequence; identical to SEQ ID NO: 3613
  hemagglutinin__InfluenzaA__ADK98799

SEQ ID NO: 5383 - protein, 566 aa, Artificial Sequence
  hemagglutinin__InfluenzaA__ADK98810
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQTFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKEVELKSGYKDWILWISFAISCFLLCVALLGFIMWACQKGNIRCNICI

SEQ ID NO: 5384 - protein, 566 aa, Artificial Sequence
  hemagglutinin__InfluenzaA__ADK98821
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5385 - protein, 566 aa, Artificial Sequence; identical to SEQ ID NO: 2434
  hemagglutinin__InfluenzaA__ADK98832

SEQ ID NO: 5386 - protein, 566 aa, Artificial Sequence; identical to SEQ ID NO: 5364
  hemagglutinin__InfluenzaA__ADK98843

SEQ ID NO: 5387 - protein, 566 aa, Artificial Sequence
  hemagglutinin__InfluenzaA__ADK98854
MKTIIALSYILCLVFTQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKPGYKDWILWISFAISCFLLCVALLGFIMWACQKGNIRCNICI

SEQ ID NO: 5388 - protein, 566 aa, Artificial Sequence
  hemagglutinin__InfluenzaA__ADK98865
MKTIIALSYILCLVFAQKLPGSDNSTATLCLGHHAVPNGTIVKTITNDQIEVTNATELVQSSSTGEICDSPHQILDGENCTLIDALLGDPQCDDFQNKKWDLFVERSKAYSNCYPYDVPDYASLRSLVASSGTLEFNNESFNWTGVTQNGTSSACIRRSSNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5389 - protein, 566 aa, Artificial Sequence
  hemagglutinin__InfluenzaA__ADK98876
MKTIIALSYILCLVFAQKLPGNDNSTATLCLGHHAVPNGTIVKTITNDQIEVTNATELVQNSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNGQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5390 - protein, 566 aa, Artificial Sequence; identical to SEQ ID NO: 5364
  hemagglutinin__InfluenzaA__ADK98887

SEQ ID NO: 5391 - protein, 566 aa, Artificial Sequence; identical to SEQ ID NO: 2434
  hemagglutinin__InfluenzaA__ADK98898

SEQ ID NO: 5392 - protein, 566 aa, Artificial Sequence
  hemagglutinin__InfluenzaA__ADK98909
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5393 - protein, 566 aa, Artificial Sequence
  hemagglutinin__InfluenzaA__ADK98920
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERGKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5394 - protein, 566 aa, Artificial Sequence; identical to SEQ ID NO: 2434
  hemagglutinin__InfluenzaA__ADK98931

SEQ ID NO: 5395 - protein, 566 aa, Artificial Sequence
  hemagglutinin__InfluenzaA__ADK98942
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVISNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHNVYRDEALNNRFQIKGVELKSGYKDWILWISFAISCFLLCVALLGFIMWACQKGNIRCNICI

SEQ ID NO: 5396 - protein, 566 aa, Artificial Sequence
  hemagglutinin__InfluenzaA__ADK98953
MKTIIALSYMLCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5397 - protein, 566 aa, Artificial Sequence; identical to SEQ ID NO: 2434
  hemagglutinin__InfluenzaA__ADK98964

SEQ ID NO: 5398 - protein, 566 aa, Artificial Sequence; identical to SEQ ID NO: 5351
  hemagglutinin__InfluenzaA__ADK98975

SEQ ID NO: 5399 - protein, 566 aa, Artificial Sequence; identical to SEQ ID NO: 5396
  hemagglutinin__InfluenzaA__ADK98986

SEQ ID NO: 5400 - protein, 566 aa, Artificial Sequence; identical to SEQ ID NO: 3613
  hemagglutinin__InfluenzaA__ADK98997

SEQ ID NO: 5401 - protein, 566 aa, Artificial Sequence; identical to SEQ ID NO: 5396
  hemagglutinin__InfluenzaA__ADK99008

SEQ ID NO: 5402 - protein, 566 aa, Artificial Sequence
  hemagglutinin__InfluenzaA__ADK99030
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNERFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5403 - protein, 566 aa, Artificial Sequence
  hemagglutinin__InfluenzaA__ADK99041
MKTIIALSYILCLVFAQKLPGNDNSTATLCLGHHAVPNGTIVKTIANDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5404 - protein, 566 aa, Artificial Sequence; identical to SEQ ID NO: 5351
  hemagglutinin__InfluenzaA__ADK99063

SEQ ID NO: 5405 - protein, 566 aa, Artificial Sequence; identical to SEQ ID NO: 2434
  hemagglutinin__InfluenzaA__ADK99085

SEQ ID NO: 5406 - protein, 566 aa, Artificial Sequence; identical to SEQ ID NO: 2434
  hemagglutinin__InfluenzaA__ADK99096

SEQ ID NO: 5407 - protein, 566 aa, Artificial Sequence; identical to SEQ ID NO: 2434
  hemagglutinin__InfluenzaA__ADK99107

SEQ ID NO: 5408 - protein, 566 aa, Artificial Sequence
  hemagglutinin__InfluenzaA__ADK99118
MKTIIALSYILCLVFAQKLPGNDNSTATLCLGHHAVPNGTIVKTITNDQIEVTNATELVQSSSTGEICDIPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCNNACIGSIRNGTYDHDVYRDEALNNRFQIKGVELKSGYKDWILWISFAISCFLLCVALLGFIMWACQKGNIRCNICI

SEQ ID NO: 5409 - protein, 566 aa, Artificial Sequence
  hemagglutinin__InfluenzaA__ADK99129
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNMTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCNNACIGSIRNGTYDHDVYRDEALNNRFQIKGVELKSGYKDWILWISFAISCFLLCVALLGFIMWACQKGNIRCNICI

SEQ ID NO: 5410 - protein, 566 aa, Artificial Sequence; identical to SEQ ID NO: 5351
  hemagglutinin__InfluenzaA__ADK99140

SEQ ID NO: 5411 - protein, 566 aa, Artificial Sequence
  hemagglutinin__InfluenzaA__ADK99151
MKTIIALSYILCLVFAQKLPGNDNSTATLCLGHHAVPNGTIVKTITNDQIEVTNATELVQSSSTGEICDSPHQILDGKNCTLIDALLGDPQCDGLQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSKCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5412 - protein, 566 aa, Artificial Sequence; identical to SEQ ID NO: 5351
  hemagglutinin__InfluenzaA__ADK99162

SEQ ID NO: 5413 - protein, 566 aa, Artificial Sequence
  hemagglutinin__InfluenzaA__ADK99173
MKTIIALSYILCLVFAQKLPGNDNSTATLCLGHHAVPNGTIVKTITNDQIEVTNATELIQSSSTGEICDSPHQILDGENCTLIDALLGDPQCDGLQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5414 - protein, 566 aa, Artificial Sequence
  hemagglutinin__InfluenzaA__ADK99184
MKTIIALSYILCLVSAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5415 - protein, 566 aa, Artificial Sequence; identical to SEQ ID NO: 2434
  hemagglutinin__InfluenzaA__ADK99195

SEQ ID NO: 5416 - protein, 566 aa, Artificial Sequence
  hemagglutinin__InfluenzaA__ADK99206
MKTIIALSYILCLVFAQKLPGNDNSTATLCLGHHAVPNGTVVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRVSIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVSLENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5417 - protein, 566 aa, Artificial Sequence; identical to SEQ ID NO: 5351
  hemagglutinin__InfluenzaA__ADK99217

SEQ ID NO: 5418 - protein, 566 aa, Artificial Sequence; identical to SEQ ID NO: 5351
  hemagglutinin__InfluenzaA__ADK99228

SEQ ID NO: 5419 - protein, 566 aa, Artificial Sequence
  hemagglutinin__InfluenzaA__ADK99239
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5420 - protein, 566 aa, Artificial Sequence
  hemagglutinin__InfluenzaA__ADK99250
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDIEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5421 - protein, 566 aa, Artificial Sequence; identical to SEQ ID NO: 5351
  hemagglutinin__InfluenzaA__ADK99261

SEQ ID NO: 5422 - protein, 566 aa, Artificial Sequence
  hemagglutinin__InfluenzaA__ADK99283
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLERYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5423 - protein, 566 aa, Artificial Sequence
  hemagglutinin__InfluenzaA__ADK99294
MKTIIALSYILCLVFAQKLPGNDNSTATLCLGHHAVPNGTIVKTITNDQIEVTNATELVQSSSTGEICDSPHQILDGENCTLIDALLGDPQCDGFQDKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5424 - protein, 566 aa, Artificial Sequence; identical to SEQ ID NO: 2434
  hemagglutinin__InfluenzaA__ADK99305

SEQ ID NO: 5425 - protein, 566 aa, Artificial Sequence; identical to SEQ ID NO: 2434
  hemagglutinin__InfluenzaA__ADL27989

SEQ ID NO: 5426 - protein, 566 aa, Artificial Sequence
  hemagglutinin__InfluenzaA__ADL28000
MKTIIALSYILCLVFAQKLPGNDNSTATLCLGHHAVPNGTMVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASERITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5427 - protein, 566 aa, Artificial Sequence
  hemagglutinin__InfluenzaA__ADL28011
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTRRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5428 - protein, 566 aa, Artificial Sequence; identical to SEQ ID NO: 5351
  hemagglutinin__InfluenzaA__ADL28022

SEQ ID NO: 5429 - protein, 566 aa, Artificial Sequence; identical to SEQ ID NO: 2434
  hemagglutinin__InfluenzaA__ADL28033

SEQ ID NO: 5430 - protein, 566 aa, Artificial Sequence; identical to SEQ ID NO: 3613
  hemagglutinin__InfluenzaA__ADL28044

SEQ ID NO: 5431 - protein, 566 aa, Artificial Sequence
  hemagglutinin__InfluenzaA__ADL28055
MKTIVALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5432 - protein, 566 aa, Artificial Sequence; identical to SEQ ID NO: 2434
  hemagglutinin__InfluenzaA__ADL28066

SEQ ID NO: 5433 - protein, 566 aa, Artificial Sequence; identical to SEQ ID NO: 5351
  hemagglutinin__InfluenzaA__ADL28077

SEQ ID NO: 5434 - protein, 566 aa, Artificial Sequence
  hemagglutinin__InfluenzaA__ADL28088
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYSQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5435 - protein, 566 aa, Artificial Sequence; identical to SEQ ID NO: 2434
  hemagglutinin__InfluenzaA__ADL28099

SEQ ID NO: 5436 - protein, 566 aa, Artificial Sequence
  hemagglutinin__InfluenzaA__ADL28110
MKTIIALSYILCLVFAQKLPGNDNSTATLCIGHHAVPNGTIVKTITNDQIEVTNATELVQNSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5437 - protein, 566 aa, Artificial Sequence
  hemagglutinin__InfluenzaA__ADL28126
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVNQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5438 - protein, 566 aa, Artificial Sequence
  hemagglutinin__InfluenzaA__ADL28137
MKTIIALSYILCLVSAQKLPGNDNSTATLCLGHHAVPNGTIVKTITNDQIEVTNATELVQSSSTGEICDGPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5439 - protein, 566 aa, Artificial Sequence; identical to SEQ ID NO: 2434
  hemagglutinin__InfluenzaA__ADL28148

SEQ ID NO: 5440 - protein, 566 aa, Artificial Sequence; identical to SEQ ID NO: 5351
  hemagglutinin__InfluenzaA__ADL28170

SEQ ID NO: 5441 - protein, 566 aa, Artificial Sequence; identical to SEQ ID NO: 2434
  hemagglutinin__InfluenzaA__ADL28181

SEQ ID NO: 5442 - protein, 566 aa, Artificial Sequence; identical to SEQ ID NO: 5346
  hemagglutinin__InfluenzaA__ADL28192

SEQ ID NO: 5443 - protein, 566 aa, Artificial Sequence; identical to SEQ ID NO: 5352
  hemagglutinin__InfluenzaA__ADL28203

SEQ ID NO: 5444 - protein, 566 aa, Artificial Sequence; identical to SEQ ID NO: 3411
  hemagglutinin__InfluenzaA__ADL28214

SEQ ID NO: 5445 - protein, 566 aa, Artificial Sequence
  hemagglutinin__InfluenzaA__ADL28225
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYSQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKTDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5446 - protein, 566 aa, Artificial Sequence; identical to SEQ ID NO: 5351
  hemagglutinin__InfluenzaA__ADL28236

SEQ ID NO: 5447 - protein, 566 aa, Artificial Sequence; identical to SEQ ID NO: 2434
  hemagglutinin__InfluenzaA__ADL28247

SEQ ID NO: 5448 - protein, 566 aa, Artificial Sequence; identical to SEQ ID NO: 5364
  hemagglutinin__InfluenzaA__ADL28258

SEQ ID NO: 5449 - protein, 566 aa, Artificial Sequence; identical to SEQ ID NO: 2434
  hemagglutinin__InfluenzaA__ADL28370

SEQ ID NO: 5450 - protein, 566 aa, Artificial Sequence; identical to SEQ ID NO: 2669
  hemagglutinin__InfluenzaA__ADL29672

SEQ ID NO: 5451 - protein, 566 aa, Artificial Sequence; identical to SEQ ID NO: 2911
  hemagglutinin__InfluenzaA__ADL29682

SEQ ID NO: 5452 - protein, 566 aa, Artificial Sequence; identical to SEQ ID NO: 2669
  hemagglutinin__InfluenzaA__ADL29692

SEQ ID NO: 5453 - protein, 566 aa, Artificial Sequence
  hemagglutinin__InfluenzaA__ADL29702
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5454 - protein, 566 aa, Artificial Sequence; identical to SEQ ID NO: 2669
  hemagglutinin__InfluenzaA__ADL29730

SEQ ID NO: 5455 - protein, 566 aa, Artificial Sequence; identical to SEQ ID NO: 2669
  hemagglutinin__InfluenzaA__ADL29740

SEQ ID NO: 5456 - protein, 566 aa, Artificial Sequence; identical to SEQ ID NO: 2669
  hemagglutinin__InfluenzaA__ADL29750

SEQ ID NO: 5457 - protein, 566 aa, Artificial Sequence
  hemagglutinin__InfluenzaA__ADL29760
MKAILVVLLYTFATANADTLCIGYHANNSTDTVDTVLEKNVTVTHSVNLLEYKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5458 - protein, 566 aa, Artificial Sequence; identical to SEQ ID NO: 2669
  hemagglutinin__InfluenzaA__ADL29770

SEQ ID NO: 5459 - protein, 566 aa, Artificial Sequence; identical to SEQ ID NO: 4169
  hemagglutinin__InfluenzaA__ADL29780

SEQ ID NO: 5460 - protein, 566 aa, Artificial Sequence
  hemagglutinin__InfluenzaA__ADL29879
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5461 - protein, 566 aa, Artificial Sequence
  hemagglutinin__InfluenzaA__ADL32017
MKAILVVLLYTFATANADTLCIGYHANNSTDTVDTVLEKNVTVTHSVNLLEDKHNGKLCQLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5462 - protein, 566 aa, Artificial Sequence
  hemagglutinin__InfluenzaA__ADL32037
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSVDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5463 - protein, 566 aa, Artificial Sequence; identical to SEQ ID NO: 2669
  hemagglutinin__InfluenzaA__ADL32047

SEQ ID NO: 5464 - protein, 566 aa, Artificial Sequence
  hemagglutinin__InfluenzaA__ADL32057
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQGLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKGTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5465 - protein, 566 aa, Artificial Sequence; identical to SEQ ID NO: 2669
  hemagglutinin__InfluenzaA__ADL32090

SEQ ID NO: 5466 - protein, 566 aa, Artificial Sequence; identical to SEQ ID NO: 2669
  hemagglutinin__InfluenzaA__ADL32114

SEQ ID NO: 5467 - protein, 566 aa, Artificial Sequence; identical to SEQ ID NO: 2669
  hemagglutinin__InfluenzaA__ADL32344

SEQ ID NO: 5468 - protein, 566 aa, Artificial Sequence; identical to SEQ ID NO: 3116
  hemagglutinin__InfluenzaA__ADL32354

SEQ ID NO: 5469 - protein, 566 aa, Artificial Sequence
  hemagglutinin__InfluenzaA__ADL32364
MKAILVVLLYTFATANADTLCIGYHANNSTDTVDTVLEKNVTVTHSVNLLEDKHNGKLCKLRGVAPLHLGKCNIAGWILGNPECESLSTAISWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5470 - protein, 566 aa, Artificial Sequence; identical to SEQ ID NO: 2669
  hemagglutinin__InfluenzaA__ADL32374

SEQ ID NO: 5471 - protein, 566 aa, Artificial Sequence
  hemagglutinin__InfluenzaA__ADL32384
MKAILVVLLYTFATATADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5472 - protein, 566 aa, Artificial Sequence
  hemagglutinin__InfluenzaA__ADL32394
MKAILVVLLYTFATANADTLCIGYHANNSTDTVDTVLEKNVTVTHSVNLLEDKHNGKLCKLRGVAPLHLGKCNIAGWILGNPECESFSTTSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5473 - protein, 566 aa, Artificial Sequence; identical to SEQ ID NO: 2669
  hemagglutinin__InfluenzaA__ADL32404

SEQ ID NO: 5474 - protein, 566 aa, Artificial Sequence
  hemagglutinin__InfluenzaA__ADL32414
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRAQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5475 - protein, 566 aa, Artificial Sequence
  hemagglutinin__InfluenzaA__ADL32424
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 5476 - protein, 566 aa, Artificial Sequence
  hemagglutinin__InfluenzaA__ADL32434
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPIHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWILVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5477 - protein, 566 aa, Artificial Sequence; identical to SEQ ID NO: 4089
  hemagglutinin__InfluenzaA__ADL32444

SEQ ID NO: 5478 - protein, 566 aa, Artificial Sequence
  hemagglutinin__InfluenzaA__ADL32454
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKELGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5479 - protein, 566 aa, Artificial Sequence; identical to SEQ ID NO: 4836
  hemagglutinin__InfluenzaA__ADL32464

SEQ ID NO: 5480 - protein, 566 aa, Artificial Sequence; identical to SEQ ID NO: 4836
  hemagglutinin__InfluenzaA__ADL32484

SEQ ID NO: 5481 - protein, 566 aa, Artificial Sequence
  hemagglutinin__InfluenzaA__ADL32504
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGMCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5482 - protein, 566 aa, Artificial Sequence; identical to SEQ ID NO: 4089
  hemagglutinin__InfluenzaA__ADL32514

SEQ ID NO: 5483 - protein, 566 aa, Artificial Sequence; identical to SEQ ID NO: 4836
  hemagglutinin__InfluenzaA__ADL32524

SEQ ID NO: 5484 - protein, 566 aa, Artificial Sequence
  hemagglutinin__InfluenzaA__ADL32544
MKAILVVLLYTFATSNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLRKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5485 - protein, 566 aa, Artificial Sequence; identical to SEQ ID NO: 5270
  hemagglutinin__InfluenzaA__ADL32554

SEQ ID NO: 5486 - protein, 566 aa, Artificial Sequence; identical to SEQ ID NO: 4282
  hemagglutinin__InfluenzaA__ADL32670

SEQ ID NO: 5487 - protein, 566 aa, Artificial Sequence
  hemagglutinin__InfluenzaA__ADL32690
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLMWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5488 - protein, 566 aa, Artificial Sequence; identical to SEQ ID NO: 2849
  hemagglutinin__InfluenzaA__ADL32710

SEQ ID NO: 5489 - protein, 566 aa, Artificial Sequence; identical to SEQ ID NO: 2669
  hemagglutinin__InfluenzaA__ADL32720

SEQ ID NO: 5490 - protein, 566 aa, Artificial Sequence; identical to SEQ ID NO: 4441
  hemagglutinin__InfluenzaA__ADL32730

SEQ ID NO: 5491 - protein, 566 aa, Artificial Sequence; identical to SEQ ID NO: 4441
  hemagglutinin__InfluenzaA__ADL32740

SEQ ID NO: 5492 - protein, 566 aa, Artificial Sequence; identical to SEQ ID NO: 3613
  hemagglutinin__InfluenzaA__ADL39137

SEQ ID NO: 5493 - protein, 565 aa, Artificial Sequence
  hemagglutinin__InfluenzaA__ADL39148
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRDFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5494 - protein, 566 aa, Artificial Sequence
  hemagglutinin__InfluenzaA__ADL39159
MKTIIALSYILCLVFAQKLPGNDNSTATLCLGHHAVPNGTIVKTITNDQIEVTNATELVQSSSTGEICDSPHQIIDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIRSIRNGTYDHDVYRDEALNNRFQIKGVELKSGYKDWILWISFAISCFLLCFALLGFIMWACQKGNIRCNICI

SEQ ID NO: 5495 - protein, 566 aa, Artificial Sequence
  hemagglutinin__InfluenzaA__ADL39170
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTVPNNEQFDKLYIWGVHHPGTDKDQIFLYAQASGRITVSTKRSQQTVIPNIGSRPRVRNIPSRISIYWTIVKPGDVLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5496 - protein, 566 aa, Artificial Sequence; identical to SEQ ID NO: 3613
  hemagglutinin__InfluenzaA__ADL39203

SEQ ID NO: 5497 - protein, 566 aa, Artificial Sequence; identical to SEQ ID NO: 2434
  hemagglutinin__InfluenzaA__ADL39214

SEQ ID NO: 5498 - protein, 565 aa, Artificial Sequence
  hemagglutinin__InfluenzaA__ADL39225
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGYFADYEELREQLSSVSSFERFEIFPKESSWPNHTVTGASASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5499 - protein, 565 aa, Artificial Sequence
  hemagglutinin__InfluenzaA__ADL39236
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGYFADYEELREQLSSVSSFERFEIFPKESSWPNHTVTGVSASCSHNGESSFYRNLLWLTGKNGLYPNLSKSYTNNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5500 - protein, 566 aa, Artificial Sequence
  hemagglutinin__InfluenzaA__ADL39280
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5501 - protein, 565 aa, Artificial Sequence
  hemagglutinin__InfluenzaA__ADL39291
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTEKNGLYPNLSKSYANNKEKEVLVLWGVHHPPNMGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5502 - protein, 566 aa, Artificial Sequence; identical to SEQ ID NO: 2434
  hemagglutinin__InfluenzaA__ADL39302

SEQ ID NO: 5503 - protein, 566 aa, Artificial Sequence; identical to SEQ ID NO: 5500
  hemagglutinin__InfluenzaA__ADL39313

SEQ ID NO: 5504 - protein, 566 aa, Artificial Sequence
  hemagglutinin__InfluenzaA__ADL39335
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5505 - protein, 566 aa, Artificial Sequence; identical to SEQ ID NO: 2434
  hemagglutinin__InfluenzaA__ADL39368

SEQ ID NO: 5506 - protein, 565 aa, Artificial Sequence
  hemagglutinin__InfluenzaA__ADL39390
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPSLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5507 - protein, 566 aa, Artificial Sequence
  hemagglutinin__InfluenzaA__ADL39401
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSSCMRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5508 - protein, 566 aa, Artificial Sequence
  hemagglutinin__InfluenzaA__ADL39412
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSEKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5509 - protein, 565 aa, Artificial Sequence
  hemagglutinin__InfluenzaA__ADL39423
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPSHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5510 - protein, 566 aa, Artificial Sequence
  hemagglutinin__InfluenzaA__ADL39434
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5511 - protein, 565 aa, Artificial Sequence
  hemagglutinin__InfluenzaA__ADL39445
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPTLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5512 - protein, 565 aa, Artificial Sequence
  hemagglutinin__InfluenzaA__ADL39456
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPSHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5513 - protein, 565 aa, Artificial Sequence
  hemagglutinin__InfluenzaA__ADL39467
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5514 - protein, 566 aa, Artificial Sequence; identical to SEQ ID NO: 2669
  hemagglutinin__InfluenzaA__ADL41164

SEQ ID NO: 5515 - protein, 566 aa, Artificial Sequence; identical to SEQ ID NO: 2762
  hemagglutinin__InfluenzaA__ADL41173

SEQ ID NO: 5516 - protein, 565 aa, Artificial Sequence
  hemagglutinin__InfluenzaA__ADL60242
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYRNLLWLTGKNGLYPNLSKSYANNKEKEVLVLWGVHHPPDIGNQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5517 - protein, 565 aa, Artificial Sequence
  hemagglutinin__InfluenzaA__ADL60253
MKVKLLVLLCTFTATYADTICIGYHANNSTDTVDTVLEKNVTVTHSVNLLENSHNGKLCLLKGIAPLQLGNCSVAGWILGNPECGLLISKESWSYIVEKPNPENGTCYPGYFADYEELREQLSSVSSFERFEIFPKESSWPNHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5518 - protein, 565 aa, Artificial Sequence; identical to SEQ ID NO: 5516
  hemagglutinin__InfluenzaA__ADL60264

SEQ ID NO: 5519 - protein, 565 aa, Artificial Sequence; identical to SEQ ID NO: 5516
  hemagglutinin__InfluenzaA__ADL60275

SEQ ID NO: 5520 - protein, 565 aa, Artificial Sequence
  hemagglutinin__InfluenzaA__ADL60286
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISNQKTLYHTENAYVSVVSSHYSRKFTPEVAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5521 - protein, 565 aa, Artificial Sequence
  hemagglutinin__InfluenzaA__ADL60297
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTRKNGLYPNLSKSYANNKEKEVLVLWGVHHPPNIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDSHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5522 - protein, 565 aa, Artificial Sequence
  hemagglutinin__InfluenzaA__ADL60308
MKVKLLVLLCTFAATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGVQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5523 - protein, 565 aa, Artificial Sequence
  hemagglutinin__InfluenzaA__ADL60341
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGVQKALYHTEIAYVSVVSSHYSRKFTPEIAKRPKVRDQEGRINYYWTILEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5524 - protein, 565 aa, Artificial Sequence
  hemagglutinin__InfluenzaA__ADL60352
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFAGYEELREQLSSVSSFERFEIFPKESSWPNHTVTGVSASCSHNGERSFYRNLLWLTGKNGLYPNLSKSYANNKEKEVLVLWGVHHPPDIGNQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5525 - protein, 566 aa, Artificial Sequence
  hemagglutinin__InfluenzaA__ADL60363
MKTIIALSYILCLVFAQKFPGNDNSTATLCLGHHAVPNGTIVKTITNDQIEVTNATELVQSSSTGEICDSPHQILDGENCTLIDALLGDPQCDGFQNKNWDLFVERSKAYSNCYPYDVPDYASLRSLIASSGTLEFNNESFNWTGVTQNGTSSACIRRSNNSFFSRLNWLTHSKFKYPALNVTMPNNENFDKLYIWGVHHPGTDNDQIFLYAQASGRITISTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGVGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 5526 - protein, 565 aa, Artificial Sequence
  hemagglutinin__InfluenzaA__ADL60374
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHDGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRVVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5527 - protein, 566 aa, Artificial Sequence
  hemagglutinin__InfluenzaA__ADM07135
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHESNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5528 - protein, 566 aa, Artificial Sequence; identical to SEQ ID NO: 3154
  hemagglutinin__InfluenzaA__ADM07144

SEQ ID NO: 5529 - protein, 566 aa, Artificial Sequence
  hemagglutinin__InfluenzaA__ADM07154
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMVRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5530 - protein, 566 aa, Artificial Sequence; identical to SEQ ID NO: 3154
  hemagglutinin__InfluenzaA__ADM07163

SEQ ID NO: 5531 - protein, 565 aa, Artificial Sequence; identical to SEQ ID NO: 5513
  hemagglutinin__InfluenzaA__ADM07460

SEQ ID NO: 5532 - protein, 566 aa, Artificial Sequence
  hemagglutinin__InfluenzaA__ADM07504
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRNGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5533 - protein, 566 aa, Artificial Sequence
  hemagglutinin__InfluenzaA__ADM12806
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 5534 - protein, 566 aa, Artificial Sequence; identical to SEQ ID NO: 5533
  hemagglutinin__InfluenzaA__ADM12817

SEQ ID NO: 5535 - protein, 566 aa, Artificial Sequence; identical to SEQ ID NO: 5533
  hemagglutinin__InfluenzaA__ADM12828

SEQ ID NO: 5536 - protein, 566 aa, Artificial Sequence; identical to SEQ ID NO: 5533
  hemagglutinin__InfluenzaA__ADM12839

SEQ ID NO: 5537 - protein, 566 aa, Artificial Sequence
  hemagglutinin__InfluenzaA__ADM12850
MKAIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 5538 - protein, 566 aa, Artificial Sequence; identical to SEQ ID NO: 2669
  hemagglutinin__InfluenzaA__ADM12861

SEQ ID NO: 5539 - protein, 566 aa, Artificial Sequence; identical to SEQ ID NO: 2669
  hemagglutinin__InfluenzaA__ADM12871

SEQ ID NO: 5540 - protein, 566 aa, Artificial Sequence; identical to SEQ ID NO: 2669
  hemagglutinin__InfluenzaA__ADM12881

SEQ ID NO: 5541 - protein, 566 aa, Artificial Sequence; identical to SEQ ID NO: 2669
  hemagglutinin__InfluenzaA__ADM12891

SEQ ID NO: 5542 - protein, 566 aa, Artificial Sequence; identical to SEQ ID NO: 2669
  hemagglutinin__InfluenzaA__ADM12901

SEQ ID NO: 5543 - protein, 566 aa, Artificial Sequence; identical to SEQ ID NO: 3771
  hemagglutinin__InfluenzaA__ADM12911

SEQ ID NO: 5544 - protein, 566 aa, Artificial Sequence; identical to SEQ ID NO: 2669
  hemagglutinin__InfluenzaA__ADM12921

SEQ ID NO: 5545 - protein, 566 aa, Artificial Sequence; identical to SEQ ID NO: 2669
  hemagglutinin__InfluenzaA__ADM12931

SEQ ID NO: 5546 - protein, 566 aa, Artificial Sequence; identical to SEQ ID NO: 2669
  hemagglutinin__InfluenzaA__ADM12941

SEQ ID NO: 5547 - protein, 566 aa, Artificial Sequence; identical to SEQ ID NO: 2669
  hemagglutinin__InfluenzaA__ADM12951

SEQ ID NO: 5548 - protein, 566 aa, Artificial Sequence
  hemagglutinin__InfluenzaA__ADM12961
MKAVLVVLLYTFATANADTLCIGYHANNSTDTVDTVLEKNVTVTHSVNILEDKHNGKLCKLGGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5549 - protein, 566 aa, Artificial Sequence; identical to SEQ ID NO: 4318
  hemagglutinin__InfluenzaA__ADM12971

SEQ ID NO: 5550 - protein, 566 aa, Artificial Sequence; identical to SEQ ID NO: 3770
  hemagglutinin__InfluenzaA__ADM12981

SEQ ID NO: 5551 - protein, 566 aa, Artificial Sequence
  hemagglutinin__InfluenzaA__ADM12991
MKAILVVLLYTFETANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5552 - protein, 566 aa, Artificial Sequence
  hemagglutinin__InfluenzaA__ADM13001
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5553 - protein, 566 aa, Artificial Sequence; identical to SEQ ID NO: 3833
  hemagglutinin__InfluenzaA__ADM13011

SEQ ID NO: 5554 - protein, 566 aa, Artificial Sequence
  hemagglutinin__InfluenzaA__ADM13021
MKAILVVLLYTFATANADTLCIGYHANNSTDTIDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5555 - protein, 566 aa, Artificial Sequence; identical to SEQ ID NO: 4015
  hemagglutinin__InfluenzaA__ADM13031

SEQ ID NO: 5556 - protein, 566 aa, Artificial Sequence
  hemagglutinin__InfluenzaA__ADM13041
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5557 - protein, 566 aa, Artificial Sequence
  hemagglutinin__InfluenzaA__ADM13051
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5558 - protein, 566 aa, Artificial Sequence
  hemagglutinin__InfluenzaA__ADM13061
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTSCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5559 - protein, 566 aa, Artificial Sequence; identical to SEQ ID NO: 4836
  hemagglutinin__InfluenzaA__ADM13071

SEQ ID NO: 5560 - protein, 566 aa, Artificial Sequence
  hemagglutinin__InfluenzaA__ADM13081
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSGSDNGTCYPGDFIDYEELREQLSSVSSFERFEIFPKTSSWPNHDSNKGVTAACPHAGAKSFYKNLIWLVKKGNSYPKLSKSYINDKEKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5561 - protein, 566 aa, Artificial Sequence; identical to SEQ ID NO: 4089
  hemagglutinin__InfluenzaA__ADM13091

SEQ ID NO: 5562 - protein, 566 aa, Artificial Sequence; identical to SEQ ID NO: 3833
  hemagglutinin__InfluenzaA__ADM13101

SEQ ID NO: 5563 - protein, 566 aa, Artificial Sequence
  hemagglutinin__InfluenzaA__ADM13111
MKAILVVLLYTFETANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVDPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5564 - protein, 566 aa, Artificial Sequence; identical to SEQ ID NO: 2669
  hemagglutinin__InfluenzaA__ADM13121

SEQ ID NO: 5565 - protein, 566 aa, Artificial Sequence; identical to SEQ ID NO: 3833
  hemagglutinin__InfluenzaA__ADM13131

SEQ ID NO: 5566 - protein, 566 aa, Artificial Sequence; identical to SEQ ID NO: 3997
  hemagglutinin__InfluenzaA__ADM13141

SEQ ID NO: 5567 - protein, 566 aa, Artificial Sequence; identical to SEQ ID NO: 3997
  hemagglutinin__InfluenzaA__ADM13151

SEQ ID NO: 5568 - protein, 566 aa, Artificial Sequence; identical to SEQ ID NO: 3770
  hemagglutinin__InfluenzaA__ADM13161

SEQ ID NO: 5569 - protein, 566 aa, Artificial Sequence; identical to SEQ ID NO: 4318
  hemagglutinin__InfluenzaA__ADM13171

SEQ ID NO: 5570 - protein, 566 aa, Artificial Sequence; identical to SEQ ID NO: 4318
  hemagglutinin__InfluenzaA__ADM13181

SEQ ID NO: 5571 - protein, 566 aa, Artificial Sequence
  hemagglutinin__InfluenzaA__ADM13191
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5572 - protein, 566 aa, Artificial Sequence
  hemagglutinin__InfluenzaA__ADM13211
MKAILVVLLYTLATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5573 - protein, 566 aa, Artificial Sequence; identical to SEQ ID NO: 5572
  hemagglutinin__InfluenzaA__ADM13221

SEQ ID NO: 5574 - protein, 566 aa, Artificial Sequence
  hemagglutinin__InfluenzaA__ADM13231
MKAILVVLLYTFETANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5575 - protein, 566 aa, Artificial Sequence; identical to SEQ ID NO: 3833
  hemagglutinin__InfluenzaA__ADM13241

SEQ ID NO: 5576 - protein, 566 aa, Artificial Sequence
  hemagglutinin__InfluenzaA__ADM13251
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5577 - protein, 566 aa, Artificial Sequence
  hemagglutinin__InfluenzaA__ADM13261
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSGSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5578 - protein, 566 aa, Artificial Sequence
  hemagglutinin__InfluenzaA__ADM13271
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIHQILAIYSTVASSLVLVVSLGAISFWMCSNGSLQCRICI

SEQ ID NO: 5579 - protein, 566 aa, Artificial Sequence; identical to SEQ ID NO: 5574
  hemagglutinin__InfluenzaA__ADM13281

SEQ ID NO: 5580 - protein, 566 aa, Artificial Sequence; identical to SEQ ID NO: 3770
  hemagglutinin__InfluenzaA__ADM13291

SEQ ID NO: 5581 - protein, 566 aa, Artificial Sequence
  hemagglutinin__InfluenzaA__ADM13301
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQSLYQNVDAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5582 - protein, 566 aa, Artificial Sequence
  hemagglutinin__InfluenzaA__ADM13311
MKAILVVLLYTFATANADTLCIGYHANNSTDTVDTILEKNVTVTHSVNLLENKHNGKLCKLRGVSPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5583 - protein, 566 aa, Artificial Sequence; identical to SEQ ID NO: 3833
  hemagglutinin__InfluenzaA__ADM13321

SEQ ID NO: 5584 - protein, 566 aa, Artificial Sequence
  hemagglutinin__InfluenzaA__ADM13331
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5585 - protein, 566 aa, Artificial Sequence; identical to SEQ ID NO: 4282
  hemagglutinin__InfluenzaA__ADM13341

SEQ ID NO: 5586 - protein, 566 aa, Artificial Sequence; identical to SEQ ID NO: 5248
  hemagglutinin__InfluenzaA__ADM13351

SEQ ID NO: 5587 - protein, 566 aa, Artificial Sequence; identical to SEQ ID NO: 2329
  hemagglutinin__InfluenzaA__ADM13442

SEQ ID NO: 5588 - protein, 566 aa, Artificial Sequence; identical to SEQ ID NO: 2329
  hemagglutinin__InfluenzaA__ADM13443

SEQ ID NO: 5589 - protein, 566 aa, Artificial Sequence; identical to SEQ ID NO: 2329
  hemagglutinin__InfluenzaA__ADM13444

SEQ ID NO: 5590 - protein, 566 aa, Artificial Sequence; identical to SEQ ID NO: 3276
  hemagglutinin__InfluenzaA__ADM13445

SEQ ID NO: 5591 - protein, 566 aa, Artificial Sequence; identical to SEQ ID NO: 2329
  hemagglutinin__InfluenzaA__ADM13446

SEQ ID NO: 5592 - protein, 566 aa, Artificial Sequence
  hemagglutinin__InfluenzaA__ADM13447
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYSVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 5593 - protein, 566 aa, Artificial Sequence; identical to SEQ ID NO: 2399
  hemagglutinin__InfluenzaA__ADM13448

SEQ ID NO: 5594 - protein, 566 aa, Artificial Sequence
  hemagglutinin__InfluenzaA__ADM13449
MKTIIALSYIFCLAFGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIESRPWVRGLSSRISIYWTIVNPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 5595 - protein, 566 aa, Artificial Sequence; identical to SEQ ID NO: 2431
  hemagglutinin__InfluenzaA__ADM13450

SEQ ID NO: 5596 - protein, 566 aa, Artificial Sequence
  hemagglutinin__InfluenzaA__ADM13451
MKTIIALSYIFCLALGQDLPGNDNRTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQATIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 5597 - protein, 566 aa, Artificial Sequence; identical to SEQ ID NO: 2316
  hemagglutinin__InfluenzaA__ADM13452

SEQ ID NO: 5598 - protein, 566 aa, Artificial Sequence
  hemagglutinin__InfluenzaA__ADM14467
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQSIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5599 - protein, 564 aa, Artificial Sequence
  hemagglutinin__InfluenzaA__ADM14516
MKAILVVLLYTFATANADTLCIGYHANNSTDTVNTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5600 - protein, 566 aa, Artificial Sequence
  hemagglutinin__InfluenzaA__ADM14525
MKATLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSLSSFERFEIFPKTSSWPNHDSNKGVTAACPHAGAKSFYKNLIWLVKKGNSYPKLSKSYINDKGKDVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5601 - protein, 564 aa, Artificial Sequence
  hemagglutinin__InfluenzaA__ADM14553
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVETSRYSKKFKPEIAIRPKVRDQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5602 - protein, 566 aa, Artificial Sequence; identical to SEQ ID NO: 3116
  hemagglutinin__InfluenzaA__ADM14562

SEQ ID NO: 5603 - protein, 566 aa, Artificial Sequence; identical to SEQ ID NO: 2669
  hemagglutinin__InfluenzaA__ADM14571

SEQ ID NO: 5604 - protein, 566 aa, Artificial Sequence
  hemagglutinin__InfluenzaA__ADM14580
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 5605 - protein, 566 aa, Artificial Sequence
  hemagglutinin__InfluenzaA__ADM14589
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNGQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 5606 - protein, 566 aa, Artificial Sequence
  hemagglutinin__InfluenzaA__ADM14599
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIVIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5607 - protein, 566 aa, Artificial Sequence; identical to SEQ ID NO: 3829
  hemagglutinin__InfluenzaA__ADM14609

SEQ ID NO: 5608 - protein, 566 aa, Artificial Sequence
  hemagglutinin__InfluenzaA__ADM14618
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNNHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5609 - protein, 566 aa, Artificial Sequence; identical to SEQ ID NO: 2669
  hemagglutinin__InfluenzaA__ADM14627

SEQ ID NO: 5610 - protein, 566 aa, Artificial Sequence
  hemagglutinin__InfluenzaA__ADM14655
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVRSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5611 - protein, 566 aa, Artificial Sequence
  hemagglutinin__InfluenzaA__ADM14664
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5612 - protein, 566 aa, Artificial Sequence; identical to SEQ ID NO: 2669
  hemagglutinin__InfluenzaA__ADM14673

SEQ ID NO: 5613 - protein, 566 aa, Artificial Sequence; identical to SEQ ID NO: 2669
  hemagglutinin__InfluenzaA__ADM14682

SEQ ID NO: 5614 - protein, 566 aa, Artificial Sequence; identical to SEQ ID NO: 2669
  hemagglutinin__InfluenzaA__ADM14691

SEQ ID NO: 5615 - protein, 566 aa, Artificial Sequence; identical to SEQ ID NO: 3833
  hemagglutinin__InfluenzaA__ADM14700

SEQ ID NO: 5616 - protein, 564 aa, Artificial Sequence
  hemagglutinin__InfluenzaA__ADM14709
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKINSVIEKMNTQFTAVGKEFNHLEKRIENLNKKVDDGFLDIWTYNAELLVLLENERTLNYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5617 - protein, 566 aa, Artificial Sequence
  hemagglutinin__InfluenzaA__ADM14718
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSMSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5618 - protein, 564 aa, Artificial Sequence
  hemagglutinin__InfluenzaA__ADM14728
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSNSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5619 - protein, 566 aa, Artificial Sequence
  hemagglutinin__InfluenzaA__ADM14737
MKAILVVLLYTFATANADTLCIGYHANNSTDTVNTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5620 - protein, 566 aa, Artificial Sequence
  hemagglutinin__InfluenzaA__ADM14746
MKAILVVLLYTFATANADTLCIGYHANNSTDTVDTVLEKNVTVTHSVNLLEDKHNGKLCKLRGVAPLHLGKCNIAGWVLGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSKKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5621 - protein, 564 aa, Artificial Sequence
  hemagglutinin__InfluenzaA__ADM14756
MKAILVVLLYTFATANADTLCVGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5622 - protein, 566 aa, Artificial Sequence; identical to SEQ ID NO: 3833
  hemagglutinin__InfluenzaA__ADM14765

SEQ ID NO: 5623 - protein, 564 aa, Artificial Sequence
  hemagglutinin__InfluenzaA__ADM14775
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5624 - protein, 564 aa, Artificial Sequence
  hemagglutinin__InfluenzaA__ADM14802
MKAILVVLLYTFATANADTLCIGYHANNSTDTVDTVLEKNVTVTHSVNLLEDKHNGKLCKIRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5625 - protein, 567 aa, Artificial Sequence
  hemagglutinin__InfluenzaA__ADM14830
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAESGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCLQCRICI

SEQ ID NO: 5626 - protein, 564 aa, Artificial Sequence
  hemagglutinin__InfluenzaA__ADM14848
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5627 - protein, 564 aa, Artificial Sequence
  hemagglutinin__InfluenzaA__ADM14866
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSIKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5628 - protein, 564 aa, Artificial Sequence
  hemagglutinin__InfluenzaA__ADM14876
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKEKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5629 - protein, 567 aa, Artificial Sequence
  hemagglutinin__InfluenzaA__ADM14885
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKEKEVLVLWGIHHPSTSADQQSLYQNADAYVFVGTSRYSKKFKPEIVIRPKVRDQEGRMNYYWTLVEPGDKITFEATGNLVVPRYAFAMERNAESGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHGSLQCRICI

SEQ ID NO: 5630 - protein, 564 aa, Artificial Sequence
  hemagglutinin__InfluenzaA__ADM14894
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKEKEVLVLWGIHHPSTSADQQSLYQNADAYVFVGTSRYSKKFKPEIVIRPKVRDQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMKSVKNGTYDYPKYSEEAKLNREEIDGVKLESTRIYQILAIYSTVASSLVLVVSLGAISFWMCSGHSCRICI

SEQ ID NO: 5631 - protein, 564 aa, Artificial Sequence
  hemagglutinin__InfluenzaA__ADM14903
MKAILVVLLCTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5632 - protein, 564 aa, Artificial Sequence
  hemagglutinin__InfluenzaA__ADM14912
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5633 - protein, 564 aa, Artificial Sequence
  hemagglutinin__InfluenzaA__ADM14921
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5634 - protein, 566 aa, Artificial Sequence; identical to SEQ ID NO: 3833
  hemagglutinin__InfluenzaA__ADM14930

SEQ ID NO: 5635 - protein, 566 aa, Artificial Sequence
  hemagglutinin__InfluenzaA__ADM14948
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADAYVFVGTSRYSRKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5636 - protein, 564 aa, Artificial Sequence
  hemagglutinin__InfluenzaA__ADM14966
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSGHSCRICI

SEQ ID NO: 5637 - protein, 566 aa, Artificial Sequence; identical to SEQ ID NO: 2849
  hemagglutinin__InfluenzaA__ADM14975

SEQ ID NO: 5638 - protein, 566 aa, Artificial Sequence
  hemagglutinin__InfluenzaA__ADM14985
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKEKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIVISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5639 - protein, 566 aa, Artificial Sequence
  hemagglutinin__InfluenzaA__ADM23841
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHQSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5640 - protein, 566 aa, Artificial Sequence; identical to SEQ ID NO: 3833
  hemagglutinin__InfluenzaA__ADM23843

SEQ ID NO: 5641 - protein, 566 aa, Artificial Sequence
  hemagglutinin__InfluenzaA__ADM23844
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDSNKGVTTACPHAGAKGFYKNLIWLVKKGNSYPKLSKSYINDKGKEVLVLWGIHHQSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5642 - protein, 566 aa, Artificial Sequence
  hemagglutinin__InfluenzaA__ADM23845
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHQSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5643 - protein, 566 aa, Artificial Sequence
  hemagglutinin__InfluenzaA__ADM23846
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5644 - protein, 566 aa, Artificial Sequence
  hemagglutinin__InfluenzaA__ADM23847
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDSNKGVTTACPHAGAKGFYKNLIWLVKKGNSYPKLSKSYINDKGKEVLVLWGIHHQSTSADQQSLYQNADAYVFVGTSRYSKKFKPEIAIRPKVRDQEGRMNYYWTLVEPGDKITFEATGNLVVPRYAFAMERNVGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5645 - protein, 566 aa, Artificial Sequence
  hemagglutinin__InfluenzaA__ADM23849
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHQSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5646 - protein, 566 aa, Artificial Sequence
  hemagglutinin__InfluenzaA__ADM23851
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHQSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 5647 - protein, 566 aa, Artificial Sequence
  hemagglutinin__InfluenzaA__ADM23852
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 5648 - protein, 566 aa, Artificial Sequence; identical to SEQ ID NO: 5647
  hemagglutinin__InfluenzaA__ADM23853

SEQ ID NO: 5649 - protein, 566 aa, Artificial Sequence; identical to SEQ ID NO: 2911
  hemagglutinin__InfluenzaA__ADM23855

SEQ ID NO: 5650 - protein, 566 aa, Artificial Sequence
  hemagglutinin__InfluenzaA__ADM23856
MKAILVVLLYTFATVNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKRKEVLVLWGIHHQSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5651 - protein, 566 aa, Artificial Sequence; identical to SEQ ID NO: 2669
  hemagglutinin__InfluenzaA__ADM25945

SEQ ID NO: 5652 - protein, 566 aa, Artificial Sequence; identical to SEQ ID NO: 2911
  hemagglutinin__InfluenzaA__ADM25948

SEQ ID NO: 5653 - protein, 566 aa, Artificial Sequence; identical to SEQ ID NO: 4698
  hemagglutinin__InfluenzaA__ADM26264

SEQ ID NO: 5654 - protein, 566 aa, Artificial Sequence; identical to SEQ ID NO: 4698
  hemagglutinin__InfluenzaA__ADM26265

SEQ ID NO: 5655 - protein, 566 aa, Artificial Sequence; identical to SEQ ID NO: 4698
  hemagglutinin__InfluenzaA__ADM26266

SEQ ID NO: 5656 - protein, 566 aa, Artificial Sequence; identical to SEQ ID NO: 4698
  hemagglutinin__InfluenzaA__ADM26267

SEQ ID NO: 5657 - protein, 566 aa, Artificial Sequence
  hemagglutinin__InfluenzaA__ADM26268
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLKREEIDGVKLESTRIYQILAIYSTVASSLVLVVSLGAISFWMCSNGSLQCRICI

SEQ ID NO: 5658 - protein, 566 aa, Artificial Sequence
  hemagglutinin__InfluenzaA__ADM26269
MKTILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLKREEIDGVKLESTRIYQILAIYSTVASSLVLVVSLGAISFWMCSNGSLQCRICI

SEQ ID NO: 5659 - protein, 566 aa, Artificial Sequence
  hemagglutinin__InfluenzaA__ADM26270
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGRCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDHHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5660 - protein, 566 aa, Artificial Sequence; identical to SEQ ID NO: 4698
  hemagglutinin__InfluenzaA__ADM26271

SEQ ID NO: 5661 - protein, 566 aa, Artificial Sequence
  hemagglutinin__InfluenzaA__ADM26272
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGRCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5662 - protein, 566 aa, Artificial Sequence
  hemagglutinin__InfluenzaA__ADM26274
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKDLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5663 - protein, 566 aa, Artificial Sequence; identical to SEQ ID NO: 4698
  hemagglutinin__InfluenzaA__ADM26276

SEQ ID NO: 5664 - protein, 566 aa, Artificial Sequence
  hemagglutinin__InfluenzaA__ADM26277
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLIVSLGAISFWMCSNGSLQCRICI

SEQ ID NO: 5665 - protein, 566 aa, Artificial Sequence
  hemagglutinin__InfluenzaA__ADM26278
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVSVGTSRYSKKFKPEIAIRPKVREQEGRMNYYWTLVEPGDKITFEATGNLVVPRFAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLKREEIDGVKLESTRIYQILAIYSTVASSLVLVVSLGAISFWMCSNGSLQCRICI

SEQ ID NO: 5666 - protein, 566 aa, Artificial Sequence
  hemagglutinin__InfluenzaA__ADM26279
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5667 - protein, 566 aa, Artificial Sequence; identical to SEQ ID NO: 4698
  hemagglutinin__InfluenzaA__ADM26280

SEQ ID NO: 5668 - protein, 566 aa, Artificial Sequence
  hemagglutinin__InfluenzaA__ADM26281
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQSIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLERRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 5669 - protein, 566 aa, Artificial Sequence
  hemagglutinin__InfluenzaA__ADM26282
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLERRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5670 - protein, 566 aa, Artificial Sequence
  hemagglutinin__InfluenzaA__ADM26283
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 5671 - protein, 566 aa, Artificial Sequence; identical to SEQ ID NO: 4698
  hemagglutinin__InfluenzaA__ADM26284

SEQ ID NO: 5672 - protein, 566 aa, Artificial Sequence; identical to SEQ ID NO: 4698
  hemagglutinin__InfluenzaA__ADM26285

SEQ ID NO: 5673 - protein, 566 aa, Artificial Sequence
  hemagglutinin__InfluenzaA__ADM26784
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACMRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5674 - protein, 566 aa, Artificial Sequence; identical to SEQ ID NO: 2434
  hemagglutinin__InfluenzaA__ADM26795

SEQ ID NO: 5675 - protein, 566 aa, Artificial Sequence
  hemagglutinin__InfluenzaA__ADM26817
MKTTIALSHILCLVFAQKLPGNDNSTATLCLGHHAVPNGTIVKTITNDQIEVTNATELVQSSSAGEICDSPHQILDGENCTLIDALLGDPQCDGFQNKKWDLFVERRRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 5676 - protein, 567 aa, Artificial Sequence
  hemagglutinin__InfluenzaA__ADM31424
MEKIVLLFTTISLVKSDHICIGYHANNSTEQVDTIMEKNVTVTHAQDILEKTHNGKLCDLNGVKPLILKDCSVAGWLLGNPLCDEFINVPEWSYIVEKANPANDLCYPGNFNDYEELKHLLSRINHFEKIQIIPKDSWSDHEASLGVSAACSYQGNSSFFRNVVWLIKKDNAYPTIKKDYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLKDNAKELGNGCFEFYHKCNNECMESVRNGTYDYPQYSEEARLKREEISGVKLESIGIYQILSIYSTVASSLVLAIMMAGLSLWMCSNGSLQCRICI

SEQ ID NO: 5677 - protein, 566 aa, Artificial Sequence; identical to SEQ ID NO: 5270
  hemagglutinin__InfluenzaA__ADM31478

SEQ ID NO: 5678 - protein, 566 aa, Artificial Sequence
  hemagglutinin__InfluenzaA__ADM31488
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5679 - protein, 566 aa, Artificial Sequence
  hemagglutinin__InfluenzaA__ADM31498
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5680 - protein, 566 aa, Artificial Sequence
  hemagglutinin__InfluenzaA__ADM31508
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTRSWPNHDSNKGVTAACPHAGAKSFYKSLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5681 - protein, 566 aa, Artificial Sequence
  hemagglutinin__InfluenzaA__ADM31518
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYVNDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5682 - protein, 566 aa, Artificial Sequence
  hemagglutinin__InfluenzaA__ADM31528
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5683 - protein, 566 aa, Artificial Sequence
  hemagglutinin__InfluenzaA__ADM31538
MKAILVVLLYTFATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5684 - protein, 566 aa, Artificial Sequence
  hemagglutinin__InfluenzaA__ADM31548
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEVAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5685 - protein, 566 aa, Artificial Sequence
  hemagglutinin__InfluenzaA__ADM31558
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIRNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5686 - protein, 566 aa, Artificial Sequence; identical to SEQ ID NO: 4266
  hemagglutinin__InfluenzaA__ADM31568

SEQ ID NO: 5687 - protein, 566 aa, Artificial Sequence; identical to SEQ ID NO: 2669
  hemagglutinin__InfluenzaA__ADM31578

SEQ ID NO: 5688 - protein, 566 aa, Artificial Sequence
  hemagglutinin__InfluenzaA__ADM31588
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKTEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5689 - protein, 566 aa, Artificial Sequence
  hemagglutinin__InfluenzaA__ADM31598
MNAILVVLLYTFATANADTLCIGYHANNSTDTVDTLLEKNVTVTHSVNLLEDKHNGKLCKLRGVAPLHLGKCDIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDAPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKINSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5690 - protein, 566 aa, Artificial Sequence
  hemagglutinin__InfluenzaA__ADM31608
MKAILVVLLYTFATVNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5691 - protein, 566 aa, Artificial Sequence; identical to SEQ ID NO: 4221
  hemagglutinin__InfluenzaA__ADM31618

SEQ ID NO: 5692 - protein, 566 aa, Artificial Sequence; identical to SEQ ID NO: 3833
  hemagglutinin__InfluenzaA__ADM31628

SEQ ID NO: 5693 - protein, 566 aa, Artificial Sequence; identical to SEQ ID NO: 5572
  hemagglutinin__InfluenzaA__ADM31638

SEQ ID NO: 5694 - protein, 566 aa, Artificial Sequence; identical to SEQ ID NO: 4089
  hemagglutinin__InfluenzaA__ADM31648

SEQ ID NO: 5695 - protein, 566 aa, Artificial Sequence; identical to SEQ ID NO: 4836
  hemagglutinin__InfluenzaA__ADM31658

SEQ ID NO: 5696 - protein, 566 aa, Artificial Sequence; identical to SEQ ID NO: 4089
  hemagglutinin__InfluenzaA__ADM31668

SEQ ID NO: 5697 - protein, 566 aa, Artificial Sequence; identical to SEQ ID NO: 2669
  hemagglutinin__InfluenzaA__ADM31688

SEQ ID NO: 5698 - protein, 566 aa, Artificial Sequence
  hemagglutinin__InfluenzaA__ADM31698
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLILVVSLGAISFWMCSNGSLQCRICI

SEQ ID NO: 5699 - protein, 566 aa, Artificial Sequence; identical to SEQ ID NO: 5574
  hemagglutinin__InfluenzaA__ADM31708

SEQ ID NO: 5700 - protein, 566 aa, Artificial Sequence
  hemagglutinin__InfluenzaA__ADM31718
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5701 - protein, 566 aa, Artificial Sequence
  hemagglutinin__InfluenzaA__ADM31728
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIITSDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5702 - protein, 566 aa, Artificial Sequence
  hemagglutinin__InfluenzaA__ADM31738
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGARSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5703 - protein, 566 aa, Artificial Sequence; identical to SEQ ID NO: 4318
  hemagglutinin__InfluenzaA__ADM31748

SEQ ID NO: 5704 - protein, 566 aa, Artificial Sequence
  hemagglutinin__InfluenzaA__ADM31758
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLIDPGDKITFEATGNLVVPRYAFAMERNAGSGIIISDTPVHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5705 - protein, 566 aa, Artificial Sequence; identical to SEQ ID NO: 3029
  hemagglutinin__InfluenzaA__ADM31768

SEQ ID NO: 5706 - protein, 566 aa, Artificial Sequence; identical to SEQ ID NO: 2669
  hemagglutinin__InfluenzaA__ADM31778

SEQ ID NO: 5707 - protein, 566 aa, Artificial Sequence; identical to SEQ ID NO: 4836
  hemagglutinin__InfluenzaA__ADM31798

SEQ ID NO: 5708 - protein, 566 aa, Artificial Sequence
  hemagglutinin__InfluenzaA__ADM31808
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLLWLVKKGNSYPKLSKSYINDKGKEVLVLWGIHHPSTSADQQSLYQNADAYVFVGTSRYSKKFKPEIAIRPKVRDQEGRMNYYWTLVGPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5709 - protein, 566 aa, Artificial Sequence; identical to SEQ ID NO: 4836
  hemagglutinin__InfluenzaA__ADM31818

SEQ ID NO: 5710 - protein, 566 aa, Artificial Sequence
  hemagglutinin__InfluenzaA__ADM31828
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGKSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLLVSLGAISFWMCSNGSLQCRICI

SEQ ID NO: 5711 - protein, 566 aa, Artificial Sequence; identical to SEQ ID NO: 5710
  hemagglutinin__InfluenzaA__ADM31838

SEQ ID NO: 5712 - protein, 566 aa, Artificial Sequence; identical to SEQ ID NO: 2669
  hemagglutinin__InfluenzaA__ADM31848

SEQ ID NO: 5713 - protein, 566 aa, Artificial Sequence
  hemagglutinin__InfluenzaA__ADM31858
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLNKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVELESTRIYQILAIYSTVASSLVLVVSLGAISFWMCSNGSLQCRICI

SEQ ID NO: 5714 - protein, 566 aa, Artificial Sequence
  hemagglutinin__InfluenzaA__ADM31868
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGVHHPSTSADQQSLYQNADAYVFVGTSRYSKKFKPEIAIRPKVRDQEGRMNYYWTLVEPGDKITFEATGNLVVPRYAFSMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 5715 - protein, 566 aa, Artificial Sequence
  hemagglutinin__InfluenzaA__ADM31878
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKASSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5716 - protein, 566 aa, Artificial Sequence; identical to SEQ ID NO: 4318
  hemagglutinin__InfluenzaA__ADM31888

SEQ ID NO: 5717 - protein, 566 aa, Artificial Sequence; identical to SEQ ID NO: 2849
  hemagglutinin__InfluenzaA__ADM31898

SEQ ID NO: 5718 - protein, 566 aa, Artificial Sequence
  hemagglutinin__InfluenzaA__ADM31908
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDHEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5719 - protein, 566 aa, Artificial Sequence; identical to SEQ ID NO: 2849
  hemagglutinin__InfluenzaA__ADM31918

SEQ ID NO: 5720 - protein, 566 aa, Artificial Sequence; identical to SEQ ID NO: 4441
  hemagglutinin__InfluenzaA__ADM31928

SEQ ID NO: 5721 - protein, 566 aa, Artificial Sequence; identical to SEQ ID NO: 4441
  hemagglutinin__InfluenzaA__ADM31948

SEQ ID NO: 5722 - protein, 566 aa, Artificial Sequence; identical to SEQ ID NO: 2669
  hemagglutinin__InfluenzaA__ADM31958

SEQ ID NO: 5723 - protein, 566 aa, Artificial Sequence; identical to SEQ ID NO: 4441
  hemagglutinin__InfluenzaA__ADM31968

SEQ ID NO: 5724 - protein, 566 aa, Artificial Sequence; identical to SEQ ID NO: 4257
  hemagglutinin__InfluenzaA__ADM31978

SEQ ID NO: 5725 - protein, 566 aa, Artificial Sequence; identical to SEQ ID NO: 2849
  hemagglutinin__InfluenzaA__ADM31998

SEQ ID NO: 5726 - protein, 566 aa, Artificial Sequence; identical to SEQ ID NO: 2849
  hemagglutinin__InfluenzaA__ADM32008

SEQ ID NO: 5727 - protein, 566 aa, Artificial Sequence
  hemagglutinin__InfluenzaA__ADM32018
MKAILVVLLYTFAIANADTLCIGYHANNSTDTVDTVLEKNVTVTHSVNLLEDKHNGKLCKLRGVAPLHLGKCDIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5728 - protein, 566 aa, Artificial Sequence
  hemagglutinin__InfluenzaA__ADM32028
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5729 - protein, 566 aa, Artificial Sequence; identical to SEQ ID NO: 4441
  hemagglutinin__InfluenzaA__ADM32038

SEQ ID NO: 5730 - protein, 566 aa, Artificial Sequence; identical to SEQ ID NO: 2849
  hemagglutinin__InfluenzaA__ADM32048

SEQ ID NO: 5731 - protein, 566 aa, Artificial Sequence; identical to SEQ ID NO: 3833
  hemagglutinin__InfluenzaA__ADM32058

SEQ ID NO: 5732 - protein, 566 aa, Artificial Sequence; identical to SEQ ID NO: 3833
  hemagglutinin__InfluenzaA__ADM32068

SEQ ID NO: 5733 - protein, 566 aa, Artificial Sequence; identical to SEQ ID NO: 2669
  hemagglutinin__InfluenzaA__ADM32078

SEQ ID NO: 5734 - protein, 566 aa, Artificial Sequence; identical to SEQ ID NO: 4257
  hemagglutinin__InfluenzaA__ADM32088

SEQ ID NO: 5735 - protein, 566 aa, Artificial Sequence
  hemagglutinin__InfluenzaA__ADM32098
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5736 - protein, 566 aa, Artificial Sequence; identical to SEQ ID NO: 2669
  hemagglutinin__InfluenzaA__ADM32108

SEQ ID NO: 5737 - protein, 566 aa, Artificial Sequence; identical to SEQ ID NO: 4441
  hemagglutinin__InfluenzaA__ADM32551

SEQ ID NO: 5738 - protein, 566 aa, Artificial Sequence; identical to SEQ ID NO: 2849
  hemagglutinin__InfluenzaA__ADM32561

SEQ ID NO: 5739 - protein, 566 aa, Artificial Sequence; identical to SEQ ID NO: 2849
  hemagglutinin__InfluenzaA__ADM32571

SEQ ID NO: 5740 - protein, 566 aa, Artificial Sequence; identical to SEQ ID NO: 2669
  hemagglutinin__InfluenzaA__ADM32581

SEQ ID NO: 5741 - protein, 566 aa, Artificial Sequence; identical to SEQ ID NO: 4441
  hemagglutinin__InfluenzaA__ADM32591

SEQ ID NO: 5742 - protein, 566 aa, Artificial Sequence; identical to SEQ ID NO: 2669
  hemagglutinin__InfluenzaA__ADM32601

SEQ ID NO: 5743 - protein, 566 aa, Artificial Sequence; identical to SEQ ID NO: 2669
  hemagglutinin__InfluenzaA__ADM32611

SEQ ID NO: 5744 - protein, 566 aa, Artificial Sequence; identical to SEQ ID NO: 3833
  hemagglutinin__InfluenzaA__ADM32621

SEQ ID NO: 5745 - protein, 566 aa, Artificial Sequence
  hemagglutinin__InfluenzaA__ADM32631
MKAILVVLLYTFATANADTLCIGYHANNSTDTVDTVLEKNVTVTHSVNILEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNLYPKLSKSYINDKGKEVLVLWGIHHPSTSADQQSLYQNADAYVFVGSSKYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5746 - protein, 566 aa, Artificial Sequence; identical to SEQ ID NO: 3833
  hemagglutinin__InfluenzaA__ADM32641

SEQ ID NO: 5747 - protein, 566 aa, Artificial Sequence; identical to SEQ ID NO: 2669
  hemagglutinin__InfluenzaA__ADM32651

SEQ ID NO: 5748 - protein, 566 aa, Artificial Sequence
  hemagglutinin__InfluenzaA__ADM32661
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFNDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5749 - protein, 566 aa, Artificial Sequence; identical to SEQ ID NO: 4257
  hemagglutinin__InfluenzaA__ADM32671

SEQ ID NO: 5750 - protein, 566 aa, Artificial Sequence; identical to SEQ ID NO: 2669
  hemagglutinin__InfluenzaA__ADM32681

SEQ ID NO: 5751 - protein, 566 aa, Artificial Sequence; identical to SEQ ID NO: 2849
  hemagglutinin__InfluenzaA__ADM32691

SEQ ID NO: 5752 - protein, 566 aa, Artificial Sequence; identical to SEQ ID NO: 2669
  hemagglutinin__InfluenzaA__ADM32701

SEQ ID NO: 5753 - protein, 566 aa, Artificial Sequence; identical to SEQ ID NO: 2849
  hemagglutinin__InfluenzaA__ADM32711

SEQ ID NO: 5754 - protein, 566 aa, Artificial Sequence; identical to SEQ ID NO: 2849
  hemagglutinin__InfluenzaA__ADM32721

SEQ ID NO: 5755 - protein, 566 aa, Artificial Sequence; identical to SEQ ID NO: 2849
  hemagglutinin__InfluenzaA__ADM32741

SEQ ID NO: 5756 - protein, 566 aa, Artificial Sequence; identical to SEQ ID NO: 2849
  hemagglutinin__InfluenzaA__ADM32751

SEQ ID NO: 5757 - protein, 566 aa, Artificial Sequence; identical to SEQ ID NO: 4257
  hemagglutinin__InfluenzaA__ADM32761

SEQ ID NO: 5758 - protein, 566 aa, Artificial Sequence
  hemagglutinin__InfluenzaA__ADM32771
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSESYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSKGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5759 - protein, 566 aa, Artificial Sequence
  hemagglutinin__InfluenzaA__ADM32781
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSFPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5760 - protein, 566 aa, Artificial Sequence; identical to SEQ ID NO: 2849
  hemagglutinin__InfluenzaA__ADM32791

SEQ ID NO: 5761 - protein, 566 aa, Artificial Sequence
  hemagglutinin__InfluenzaA__ADM32801
MKAILVVLLYTFATANADTLCIGYHANNSTDTVDTVLEKNVTVTHSVNILENKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5762 - protein, 566 aa, Artificial Sequence
  hemagglutinin__InfluenzaA__ADM32811
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5763 - protein, 566 aa, Artificial Sequence; identical to SEQ ID NO: 2669
  hemagglutinin__InfluenzaA__ADM32821

SEQ ID NO: 5764 - protein, 566 aa, Artificial Sequence; identical to SEQ ID NO: 4257
  hemagglutinin__InfluenzaA__ADM32831

SEQ ID NO: 5765 - protein, 566 aa, Artificial Sequence; identical to SEQ ID NO: 2849
  hemagglutinin__InfluenzaA__ADM32841

SEQ ID NO: 5766 - protein, 566 aa, Artificial Sequence; identical to SEQ ID NO: 4257
  hemagglutinin__InfluenzaA__ADM32851

SEQ ID NO: 5767 - protein, 566 aa, Artificial Sequence; identical to SEQ ID NO: 2849
  hemagglutinin__InfluenzaA__ADM32861

SEQ ID NO: 5768 - protein, 566 aa, Artificial Sequence; identical to SEQ ID NO: 3833
  hemagglutinin__InfluenzaA__ADM32871

SEQ ID NO: 5769 - protein, 566 aa, Artificial Sequence; identical to SEQ ID NO: 4836
  hemagglutinin__InfluenzaA__ADM32881

SEQ ID NO: 5770 - protein, 566 aa, Artificial Sequence
  hemagglutinin__InfluenzaA__ADM32929
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5771 - protein, 566 aa, Artificial Sequence
  hemagglutinin__InfluenzaA__ADM32939
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5772 - protein, 566 aa, Artificial Sequence
  hemagglutinin__InfluenzaA__ADM32949
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5773 - protein, 566 aa, Artificial Sequence
  hemagglutinin__InfluenzaA__ADM32958
MKAILVFLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVESSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRLENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLRCRICI

SEQ ID NO: 5774 - protein, 566 aa, Artificial Sequence
  hemagglutinin__InfluenzaA__ADM32977
MKAILVVLLCTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKINSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5775 - protein, 566 aa, Artificial Sequence
  hemagglutinin__InfluenzaA__ADM32986
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKINSVIEKMNTQFTAVGKEFNHLEKRIENLNKKVDDGFLDIWTYNAELLVLLENERTLNYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5776 - protein, 566 aa, Artificial Sequence
  hemagglutinin__InfluenzaA__ADM32995
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKINSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5777 - protein, 566 aa, Artificial Sequence; identical to SEQ ID NO: 3770
  hemagglutinin__InfluenzaA__ADM33004

SEQ ID NO: 5778 - protein, 566 aa, Artificial Sequence; identical to SEQ ID NO: 2669
  hemagglutinin__InfluenzaA__ADM33023

SEQ ID NO: 5779 - protein, 566 aa, Artificial Sequence
  hemagglutinin__InfluenzaA__ADM33040
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5780 - protein, 566 aa, Artificial Sequence
  hemagglutinin__InfluenzaA__ADM33050
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5781 - protein, 566 aa, Artificial Sequence
  hemagglutinin__InfluenzaA__ADM33069
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5782 - protein, 566 aa, Artificial Sequence
  hemagglutinin__InfluenzaA__ADM33079
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5783 - protein, 566 aa, Artificial Sequence
  hemagglutinin__InfluenzaA__ADM33099
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLMVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5784 - protein, 566 aa, Artificial Sequence; identical to SEQ ID NO: 5783
  hemagglutinin__InfluenzaA__ADM33109

SEQ ID NO: 5785 - protein, 566 aa, Artificial Sequence
  hemagglutinin__InfluenzaA__ADM33128
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5786 - protein, 566 aa, Artificial Sequence; identical to SEQ ID NO: 5785
  hemagglutinin__InfluenzaA__ADM33137

SEQ ID NO: 5787 - protein, 566 aa, Artificial Sequence; identical to SEQ ID NO: 5785
  hemagglutinin__InfluenzaA__ADM33147

SEQ ID NO: 5788 - protein, 566 aa, Artificial Sequence; identical to SEQ ID NO: 5785
  hemagglutinin__InfluenzaA__ADM33157

SEQ ID NO: 5789 - protein, 566 aa, Artificial Sequence
  hemagglutinin__InfluenzaA__ADM33167
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLRCRICI

SEQ ID NO: 5790 - protein, 566 aa, Artificial Sequence; identical to SEQ ID NO: 4856
  hemagglutinin__InfluenzaA__ADM33177

SEQ ID NO: 5791 - protein, 566 aa, Artificial Sequence; identical to SEQ ID NO: 5785
  hemagglutinin__InfluenzaA__ADM33186

SEQ ID NO: 5792 - protein, 566 aa, Artificial Sequence; identical to SEQ ID NO: 5785
  hemagglutinin__InfluenzaA__ADM33195

SEQ ID NO: 5793 - protein, 566 aa, Artificial Sequence; identical to SEQ ID NO: 5782
  hemagglutinin__InfluenzaA__ADM33204

SEQ ID NO: 5794 - protein, 566 aa, Artificial Sequence
  hemagglutinin__InfluenzaA__ADM33222
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5795 - protein, 566 aa, Artificial Sequence
  hemagglutinin__InfluenzaA__ADM33232
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKTNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5796 - protein, 566 aa, Artificial Sequence
  hemagglutinin__InfluenzaA__ADM33241
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQSLYQNADAYVFVGSSRYSKKFKPEITIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5797 - protein, 566 aa, Artificial Sequence; identical to SEQ ID NO: 5794
  hemagglutinin__InfluenzaA__ADM33251

SEQ ID NO: 5798 - protein, 566 aa, Artificial Sequence
  hemagglutinin__InfluenzaA__ADM33260
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGDSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNTELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLRCRICI

SEQ ID NO: 5799 - protein, 566 aa, Artificial Sequence
  hemagglutinin__InfluenzaA__ADM33280
MKAILVVLLYTFATANADTLCIGYHANNSTDTVDTVLEKNVTVTHSVNILEDKHNGKLCKLRGVAPLHLGKCNIAGWILGNPECESLSTVSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPRGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5800 - protein, 566 aa, Artificial Sequence; identical to SEQ ID NO: 3116
  hemagglutinin__InfluenzaA__ADM33290

SEQ ID NO: 5801 - protein, 566 aa, Artificial Sequence; identical to SEQ ID NO: 2669
  hemagglutinin__InfluenzaA__ADM33300

SEQ ID NO: 5802 - protein, 566 aa, Artificial Sequence; identical to SEQ ID NO: 2656
  hemagglutinin__InfluenzaA__ADM33310

SEQ ID NO: 5803 - protein, 566 aa, Artificial Sequence
  hemagglutinin__InfluenzaA__ADM33320
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETFSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5804 - protein, 566 aa, Artificial Sequence; identical to SEQ ID NO: 2695
  hemagglutinin__InfluenzaA__ADM33340

SEQ ID NO: 5805 - protein, 566 aa, Artificial Sequence
  hemagglutinin__InfluenzaA__ADM33355
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5806 - protein, 566 aa, Artificial Sequence; identical to SEQ ID NO: 5805
  hemagglutinin__InfluenzaA__ADM33365

SEQ ID NO: 5807 - protein, 566 aa, Artificial Sequence; identical to SEQ ID NO: 2695
  hemagglutinin__InfluenzaA__ADM33375

SEQ ID NO: 5808 - protein, 566 aa, Artificial Sequence
  hemagglutinin__InfluenzaA__ADM33385
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTSKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5809 - protein, 566 aa, Artificial Sequence; identical to SEQ ID NO: 3116
  hemagglutinin__InfluenzaA__ADM33395

SEQ ID NO: 5810 - protein, 566 aa, Artificial Sequence; identical to SEQ ID NO: 3116
  hemagglutinin__InfluenzaA__ADM33405

SEQ ID NO: 5811 - protein, 566 aa, Artificial Sequence; identical to SEQ ID NO: 5805
  hemagglutinin__InfluenzaA__ADM33415

SEQ ID NO: 5812 - protein, 566 aa, Artificial Sequence; identical to SEQ ID NO: 3512
  hemagglutinin__InfluenzaA__ADM33425

SEQ ID NO: 5813 - protein, 566 aa, Artificial Sequence
  hemagglutinin__InfluenzaA__ADM34007
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLEEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5814 - protein, 566 aa, Artificial Sequence; identical to SEQ ID NO: 2669
  hemagglutinin__InfluenzaA__ADM52443

SEQ ID NO: 5815 - protein, 566 aa, Artificial Sequence
  hemagglutinin__InfluenzaA__ADM52453
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPIHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5816 - protein, 566 aa, Artificial Sequence
  hemagglutinin__InfluenzaA__ADM52473
MKAILAVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLLWLVKKGNSYPKLSKSYINDKGKEVLVLWGIHHPSTSADQQSLYQNADAYVFVGTSRYSKKFKPEIAIRPKVRDQEGRMNYYWTLVGPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5817 - protein, 566 aa, Artificial Sequence; identical to SEQ ID NO: 3833
  hemagglutinin__InfluenzaA__ADM52483

SEQ ID NO: 5818 - protein, 566 aa, Artificial Sequence; identical to SEQ ID NO: 2849
  hemagglutinin__InfluenzaA__ADM52493

SEQ ID NO: 5819 - protein, 566 aa, Artificial Sequence; identical to SEQ ID NO: 2849
  hemagglutinin__InfluenzaA__ADM52513

SEQ ID NO: 5820 - protein, 566 aa, Artificial Sequence; identical to SEQ ID NO: 2849
  hemagglutinin__InfluenzaA__ADM52524

SEQ ID NO: 5821 - protein, 566 aa, Artificial Sequence; identical to SEQ ID NO: 2849
  hemagglutinin__InfluenzaA__ADM52534

SEQ ID NO: 5822 - protein, 566 aa, Artificial Sequence; identical to SEQ ID NO: 2849
  hemagglutinin__InfluenzaA__ADM52554

SEQ ID NO: 5823 - protein, 566 aa, Artificial Sequence; identical to SEQ ID NO: 2849
  hemagglutinin__InfluenzaA__ADM52564

SEQ ID NO: 5824 - protein, 566 aa, Artificial Sequence; identical to SEQ ID NO: 2656
  hemagglutinin__InfluenzaA__ADM52574

SEQ ID NO: 5825 - protein, 566 aa, Artificial Sequence; identical to SEQ ID NO: 2669
  hemagglutinin__InfluenzaA__ADM52584

SEQ ID NO: 5826 - protein, 566 aa, Artificial Sequence
  hemagglutinin__InfluenzaA__ADM52594
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5827 - protein, 566 aa, Artificial Sequence; identical to SEQ ID NO: 2849
  hemagglutinin__InfluenzaA__ADM52604

SEQ ID NO: 5828 - protein, 566 aa, Artificial Sequence; identical to SEQ ID NO: 2849
  hemagglutinin__InfluenzaA__ADM52614

SEQ ID NO: 5829 - protein, 566 aa, Artificial Sequence; identical to SEQ ID NO: 4441
  hemagglutinin__InfluenzaA__ADM52624

SEQ ID NO: 5830 - protein, 566 aa, Artificial Sequence; identical to SEQ ID NO: 2849
  hemagglutinin__InfluenzaA__ADM52634

SEQ ID NO: 5831 - protein, 566 aa, Artificial Sequence; identical to SEQ ID NO: 2849
  hemagglutinin__InfluenzaA__ADM52644

SEQ ID NO: 5832 - protein, 566 aa, Artificial Sequence; identical to SEQ ID NO: 2849
  hemagglutinin__InfluenzaA__ADM52654

SEQ ID NO: 5833 - protein, 566 aa, Artificial Sequence; identical to SEQ ID NO: 4257
  hemagglutinin__InfluenzaA__ADM52664

SEQ ID NO: 5834 - protein, 566 aa, Artificial Sequence; identical to SEQ ID NO: 4441
  hemagglutinin__InfluenzaA__ADM52674

SEQ ID NO: 5835 - protein, 566 aa, Artificial Sequence; identical to SEQ ID NO: 2849
  hemagglutinin__InfluenzaA__ADM52684

SEQ ID NO: 5836 - protein, 566 aa, Artificial Sequence; identical to SEQ ID NO: 4441
  hemagglutinin__InfluenzaA__ADM52704

SEQ ID NO: 5837 - protein, 566 aa, Artificial Sequence; identical to SEQ ID NO: 4257
  hemagglutinin__InfluenzaA__ADM52714

SEQ ID NO: 5838 - protein, 566 aa, Artificial Sequence
  hemagglutinin__InfluenzaA__ADM86399
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAVNTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5839 - protein, 566 aa, Artificial Sequence; identical to SEQ ID NO: 2669
  hemagglutinin__InfluenzaA__ADM86409

SEQ ID NO: 5840 - protein, 566 aa, Artificial Sequence; identical to SEQ ID NO: 2669
  hemagglutinin__InfluenzaA__ADM86419

SEQ ID NO: 5841 - protein, 566 aa, Artificial Sequence; identical to SEQ ID NO: 4318
  hemagglutinin__InfluenzaA__ADM86440

SEQ ID NO: 5842 - protein, 566 aa, Artificial Sequence; identical to SEQ ID NO: 2669
  hemagglutinin__InfluenzaA__ADM86450

SEQ ID NO: 5843 - protein, 568 aa, Artificial Sequence
  hemagglutinin__InfluenzaA__ADM95450
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWPSHEASLGVSAACPYQGKSSFFRNVVWLIKKNNTYPTIKRSYNNTNQEDLLVMWGIHHPNDAAEQTNLYQNPTTYISVGTSTLNQRLTPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQREGRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 5844 - protein, 566 aa, Artificial Sequence; identical to SEQ ID NO: 2669
  hemagglutinin__InfluenzaA__ADM95745

SEQ ID NO: 5845 - protein, 566 aa, Artificial Sequence; identical to SEQ ID NO: 2669
  hemagglutinin__InfluenzaA__ADM95746

SEQ ID NO: 5846 - protein, 566 aa, Artificial Sequence; identical to SEQ ID NO: 2669
  hemagglutinin__InfluenzaA__ADM95747

SEQ ID NO: 5847 - protein, 566 aa, Artificial Sequence; identical to SEQ ID NO: 2669
  hemagglutinin__InfluenzaA__ADM95749

SEQ ID NO: 5848 - protein, 566 aa, Artificial Sequence
  hemagglutinin__InfluenzaA__ADM95750
MKAILVVLLYTFATANADTLCIGYHANNSTDTVDTVLEKNVTVTHSFNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGSSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5849 - protein, 566 aa, Artificial Sequence; identical to SEQ ID NO: 2669
  hemagglutinin__InfluenzaA__ADM95751

SEQ ID NO: 5850 - protein, 566 aa, Artificial Sequence; identical to SEQ ID NO: 2669
  hemagglutinin__InfluenzaA__ADM95752

SEQ ID NO: 5851 - protein, 566 aa, Artificial Sequence; identical to SEQ ID NO: 2669
  hemagglutinin__InfluenzaA__ADM95753

SEQ ID NO: 5852 - protein, 566 aa, Artificial Sequence; identical to SEQ ID NO: 2669
  hemagglutinin__InfluenzaA__ADM95754

SEQ ID NO: 5853 - protein, 566 aa, Artificial Sequence; identical to SEQ ID NO: 2669
  hemagglutinin__InfluenzaA__ADM95755

SEQ ID NO: 5854 - protein, 566 aa, Artificial Sequence; identical to SEQ ID NO: 2849
  hemagglutinin__InfluenzaA__ADM95757

SEQ ID NO: 5855 - protein, 566 aa, Artificial Sequence; identical to SEQ ID NO: 2669
  hemagglutinin__InfluenzaA__ADM95758

SEQ ID NO: 5856 - protein, 566 aa, Artificial Sequence
  hemagglutinin__InfluenzaA__ADM95759
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDYGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5857 - protein, 566 aa, Artificial Sequence; identical to SEQ ID NO: 2656
  hemagglutinin__InfluenzaA__ADM95760

SEQ ID NO: 5858 - protein, 566 aa, Artificial Sequence; identical to SEQ ID NO: 2669
  hemagglutinin__InfluenzaA__ADM95761

SEQ ID NO: 5859 - protein, 566 aa, Artificial Sequence
  hemagglutinin__InfluenzaA__ADM95763
MKAILVVLLYTFATANADTLCIGYHANNSTDTVDTVLEKNVTVTHSVNLLEDKNNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5860 - protein, 566 aa, Artificial Sequence; identical to SEQ ID NO: 2669
  hemagglutinin__InfluenzaA__ADM95764

SEQ ID NO: 5861 - protein, 566 aa, Artificial Sequence; identical to SEQ ID NO: 2669
  hemagglutinin__InfluenzaA__ADM95765

SEQ ID NO: 5862 - protein, 566 aa, Artificial Sequence; identical to SEQ ID NO: 2669
  hemagglutinin__InfluenzaA__ADM95767

SEQ ID NO: 5863 - protein, 566 aa, Artificial Sequence; identical to SEQ ID NO: 3512
  hemagglutinin__InfluenzaA__ADM95768

SEQ ID NO: 5864 - protein, 566 aa, Artificial Sequence; identical to SEQ ID NO: 3022
  hemagglutinin__InfluenzaA__ADM95769

SEQ ID NO: 5865 - protein, 566 aa, Artificial Sequence; identical to SEQ ID NO: 4785
  hemagglutinin__InfluenzaA__ADM95771

SEQ ID NO: 5866 - protein, 566 aa, Artificial Sequence; identical to SEQ ID NO: 2669
  hemagglutinin__InfluenzaA__ADM95772

SEQ ID NO: 5867 - protein, 566 aa, Artificial Sequence; identical to SEQ ID NO: 2669
  hemagglutinin__InfluenzaA__ADM95774

SEQ ID NO: 5868 - protein, 566 aa, Artificial Sequence; identical to SEQ ID NO: 2669
  hemagglutinin__InfluenzaA__ADM95775

SEQ ID NO: 5869 - protein, 566 aa, Artificial Sequence; identical to SEQ ID NO: 3022
  hemagglutinin__InfluenzaA__ADM95776

SEQ ID NO: 5870 - protein, 566 aa, Artificial Sequence; identical to SEQ ID NO: 3022
  hemagglutinin__InfluenzaA__ADM95778

SEQ ID NO: 5871 - protein, 566 aa, Artificial Sequence
  hemagglutinin__InfluenzaA__ADM95779
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLEPTRIYQILAIYSTVASSLVLVVSLGAISFWMCSNGSLQCRICI

SEQ ID NO: 5872 - protein, 566 aa, Artificial Sequence; identical to SEQ ID NO: 3022
  hemagglutinin__InfluenzaA__ADM95780

SEQ ID NO: 5873 - protein, 566 aa, Artificial Sequence; identical to SEQ ID NO: 3512
  hemagglutinin__InfluenzaA__ADM95783

SEQ ID NO: 5874 - protein, 566 aa, Artificial Sequence; identical to SEQ ID NO: 2669
  hemagglutinin__InfluenzaA__ADM95784

SEQ ID NO: 5875 - protein, 566 aa, Artificial Sequence; identical to SEQ ID NO: 2669
  hemagglutinin__InfluenzaA__ADM95785

SEQ ID NO: 5876 - protein, 566 aa, Artificial Sequence
  hemagglutinin__InfluenzaA__ADM95786
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5877 - protein, 566 aa, Artificial Sequence; identical to SEQ ID NO: 3022
  hemagglutinin__InfluenzaA__ADM95788

SEQ ID NO: 5878 - protein, 566 aa, Artificial Sequence; identical to SEQ ID NO: 3022
  hemagglutinin__InfluenzaA__ADM95789

SEQ ID NO: 5879 - protein, 566 aa, Artificial Sequence
  hemagglutinin__InfluenzaA__ADM95790
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLRKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5880 - protein, 566 aa, Artificial Sequence; identical to SEQ ID NO: 5879
  hemagglutinin__InfluenzaA__ADM95791

SEQ ID NO: 5881 - protein, 566 aa, Artificial Sequence; identical to SEQ ID NO: 5879
  hemagglutinin__InfluenzaA__ADM95792

SEQ ID NO: 5882 - protein, 566 aa, Artificial Sequence; identical to SEQ ID NO: 5266
  hemagglutinin__InfluenzaA__ADM95793

SEQ ID NO: 5883 - protein, 566 aa, Artificial Sequence; identical to SEQ ID NO: 3022
  hemagglutinin__InfluenzaA__ADM95794

SEQ ID NO: 5884 - protein, 566 aa, Artificial Sequence; identical to SEQ ID NO: 2669
  hemagglutinin__InfluenzaA__ADM95795

SEQ ID NO: 5885 - protein, 566 aa, Artificial Sequence; identical to SEQ ID NO: 3771
  hemagglutinin__InfluenzaA__ADM95798

SEQ ID NO: 5886 - protein, 566 aa, Artificial Sequence
  hemagglutinin__InfluenzaA__ADM95799
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIENGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5887 - protein, 566 aa, Artificial Sequence
  hemagglutinin__InfluenzaA__ADM95800
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVAPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5888 - protein, 566 aa, Artificial Sequence; identical to SEQ ID NO: 3022
  hemagglutinin__InfluenzaA__ADM95801

SEQ ID NO: 5889 - protein, 566 aa, Artificial Sequence; identical to SEQ ID NO: 3022
  hemagglutinin__InfluenzaA__ADM95802

SEQ ID NO: 5890 - protein, 566 aa, Artificial Sequence; identical to SEQ ID NO: 5876
  hemagglutinin__InfluenzaA__ADM95803

SEQ ID NO: 5891 - protein, 566 aa, Artificial Sequence
  hemagglutinin__InfluenzaA__ADM95804
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKNFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5892 - protein, 566 aa, Artificial Sequence; identical to SEQ ID NO: 4351
  hemagglutinin__InfluenzaA__ADM95805

SEQ ID NO: 5893 - protein, 566 aa, Artificial Sequence; identical to SEQ ID NO: 3770
  hemagglutinin__InfluenzaA__ADM95808

SEQ ID NO: 5894 - protein, 566 aa, Artificial Sequence; identical to SEQ ID NO: 3770
  hemagglutinin__InfluenzaA__ADM95809

SEQ ID NO: 5895 - protein, 566 aa, Artificial Sequence; identical to SEQ ID NO: 3770
  hemagglutinin__InfluenzaA__ADM95810

SEQ ID NO: 5896 - protein, 566 aa, Artificial Sequence
  hemagglutinin__InfluenzaA__ADM95812
MKAILVVLLYTFATANADTLCIGYHANNSTDTVDTVLEKNVTVTHSVNLLEDKHNGKLCKLRGVAPLHLGKCNIAGWILGNPECELLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5897 - protein, 566 aa, Artificial Sequence; identical to SEQ ID NO: 5266
  hemagglutinin__InfluenzaA__ADM95816

SEQ ID NO: 5898 - protein, 566 aa, Artificial Sequence; identical to SEQ ID NO: 5266
  hemagglutinin__InfluenzaA__ADM95819

SEQ ID NO: 5899 - protein, 566 aa, Artificial Sequence; identical to SEQ ID NO: 4351
  hemagglutinin__InfluenzaA__ADM95820

SEQ ID NO: 5900 - protein, 566 aa, Artificial Sequence; identical to SEQ ID NO: 5266
  hemagglutinin__InfluenzaA__ADM95821

SEQ ID NO: 5901 - protein, 566 aa, Artificial Sequence; identical to SEQ ID NO: 3770
  hemagglutinin__InfluenzaA__ADM95822

SEQ ID NO: 5902 - protein, 566 aa, Artificial Sequence; identical to SEQ ID NO: 3770
  hemagglutinin__InfluenzaA__ADM95823

SEQ ID NO: 5903 - protein, 566 aa, Artificial Sequence
  hemagglutinin__InfluenzaA__ADM95824
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5904 - protein, 566 aa, Artificial Sequence; identical to SEQ ID NO: 5266
  hemagglutinin__InfluenzaA__ADM95825

SEQ ID NO: 5905 - protein, 566 aa, Artificial Sequence; identical to SEQ ID NO: 5266
  hemagglutinin__InfluenzaA__ADM95826

SEQ ID NO: 5906 - protein, 566 aa, Artificial Sequence
  hemagglutinin__InfluenzaA__ADM95827
MKAILVVLLYTFATANADTLCIGYHANNSTDTVDTVLEKNVTVTHSVNLLEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5907 - protein, 566 aa, Artificial Sequence
  hemagglutinin__InfluenzaA__ADM95828
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5908 - protein, 566 aa, Artificial Sequence
  hemagglutinin__InfluenzaA__ADM95829
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNMCMESVKNGTYDYPKYSEEAKLNREEIDGVKLESTRIYQILAIYSTVASSLVLVVSLGAISFWMCSNGSLQCRICI

SEQ ID NO: 5909 - protein, 566 aa, Artificial Sequence
  hemagglutinin__InfluenzaA__ADM95831
MKAILVVLLYTFVTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5910 - protein, 566 aa, Artificial Sequence; identical to SEQ ID NO: 3770
  hemagglutinin__InfluenzaA__ADM95832

SEQ ID NO: 5911 - protein, 566 aa, Artificial Sequence; identical to SEQ ID NO: 4351
  hemagglutinin__InfluenzaA__ADM95833

SEQ ID NO: 5912 - protein, 566 aa, Artificial Sequence; identical to SEQ ID NO: 5896
  hemagglutinin__InfluenzaA__ADM95834

SEQ ID NO: 5913 - protein, 566 aa, Artificial Sequence; identical to SEQ ID NO: 4351
  hemagglutinin__InfluenzaA__ADM95836

SEQ ID NO: 5914 - protein, 566 aa, Artificial Sequence; identical to SEQ ID NO: 5266
  hemagglutinin__InfluenzaA__ADM95837

SEQ ID NO: 5915 - protein, 566 aa, Artificial Sequence
  hemagglutinin__InfluenzaA__ADM95838
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACLHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5916 - protein, 566 aa, Artificial Sequence; identical to SEQ ID NO: 4351
  hemagglutinin__InfluenzaA__ADM95839

SEQ ID NO: 5917 - protein, 566 aa, Artificial Sequence; identical to SEQ ID NO: 5876
  hemagglutinin__InfluenzaA__ADM95840

SEQ ID NO: 5918 - protein, 566 aa, Artificial Sequence; identical to SEQ ID NO: 5876
  hemagglutinin__InfluenzaA__ADM95842

SEQ ID NO: 5919 - protein, 566 aa, Artificial Sequence; identical to SEQ ID NO: 5266
  hemagglutinin__InfluenzaA__ADM95843

SEQ ID NO: 5920 - protein, 566 aa, Artificial Sequence; identical to SEQ ID NO: 5266
  hemagglutinin__InfluenzaA__ADM95844

SEQ ID NO: 5921 - protein, 566 aa, Artificial Sequence
  hemagglutinin__InfluenzaA__ADM95845
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEETKLNREEIDGVKLESTRIYQILAIYSTVASSLVLVVSLGAISFWMCSNGSLQCRICI

SEQ ID NO: 5922 - protein, 566 aa, Artificial Sequence
  hemagglutinin__InfluenzaA__ADM95846
MKAILVVLLYTFATANADTLCIGYHANNSTDTVDTVLEKNVTVTHSVNLLEDKHNGKLCKLRGVAPLHLGKCNIAGWILGNPECESLSTASSWSYIVEASSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5923 - protein, 566 aa, Artificial Sequence; identical to SEQ ID NO: 3770
  hemagglutinin__InfluenzaA__ADM95847

SEQ ID NO: 5924 - protein, 566 aa, Artificial Sequence; identical to SEQ ID NO: 3770
  hemagglutinin__InfluenzaA__ADM95848

SEQ ID NO: 5925 - protein, 566 aa, Artificial Sequence
  hemagglutinin__InfluenzaA__ADM95849
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVISLGAISFWMCSNGSLQCRICI

SEQ ID NO: 5926 - protein, 566 aa, Artificial Sequence; identical to SEQ ID NO: 5266
  hemagglutinin__InfluenzaA__ADM95850

SEQ ID NO: 5927 - protein, 566 aa, Artificial Sequence
  hemagglutinin__InfluenzaA__ADM95851
MKAILVVLLYTFATANADTLCIGYHANNSTDTVDTVLEKNVTVTHSVNLLEDKHNGKLCKLRGVAPLHLGKCNIAGWILGNPECESLSTTSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5928 - protein, 566 aa, Artificial Sequence
  hemagglutinin__InfluenzaA__ADM95852
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKIRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5929 - protein, 566 aa, Artificial Sequence; identical to SEQ ID NO: 4089
  hemagglutinin__InfluenzaA__ADM95854

SEQ ID NO: 5930 - protein, 566 aa, Artificial Sequence
  hemagglutinin__InfluenzaA__ADM95855
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5931 - protein, 566 aa, Artificial Sequence
  hemagglutinin__InfluenzaA__ADM95857
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5932 - protein, 566 aa, Artificial Sequence; identical to SEQ ID NO: 4351
  hemagglutinin__InfluenzaA__ADM95858

SEQ ID NO: 5933 - protein, 566 aa, Artificial Sequence
  hemagglutinin__InfluenzaA__ADM95859
MKAILVVLLYTFATANADTLCIGYHANNSTDTVDTVLEKNVTVTHSVNLLEDKHNEKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5934 - protein, 566 aa, Artificial Sequence; identical to SEQ ID NO: 4296
  hemagglutinin__InfluenzaA__ADM95860

SEQ ID NO: 5935 - protein, 566 aa, Artificial Sequence; identical to SEQ ID NO: 5896
  hemagglutinin__InfluenzaA__ADM95862

SEQ ID NO: 5936 - protein, 566 aa, Artificial Sequence
  hemagglutinin__InfluenzaA__ADM95864
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPRVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5937 - protein, 566 aa, Artificial Sequence; identical to SEQ ID NO: 4221
  hemagglutinin__InfluenzaA__ADM95865

SEQ ID NO: 5938 - protein, 566 aa, Artificial Sequence
  hemagglutinin__InfluenzaA__ADM95866
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVEISSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLVTGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 5939 - protein, 565 aa, Artificial Sequence; identical to SEQ ID NO: 5513
  hemagglutinin__InfluenzaA__ADN06300

SEQ ID NO: 5940 - protein, 565 aa, Artificial Sequence
  hemagglutinin__InfluenzaA__ADN06311
MKVKLLVLLCTLTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKGSSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5941 - protein, 565 aa, Artificial Sequence
  hemagglutinin__InfluenzaA__ADN06322
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNMVDQRTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5942 - protein, 565 aa, Artificial Sequence
  hemagglutinin__InfluenzaA__ADN06344
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5943 - protein, 566 aa, Artificial Sequence; identical to SEQ ID NO: 5533
  hemagglutinin__InfluenzaA__ADN06366

SEQ ID NO: 5944 - protein, 566 aa, Artificial Sequence
  hemagglutinin__InfluenzaA__ADN26165
MKAILVVLLYTFATANADTLCIGYHANNSTDTVDTVLEKNVTVTHSVNLLEGKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLIKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESARIYQILAIYSTVASSLVLVVSLGAISFWMCSNGSLQCRICI

SEQ ID NO: 5945 - protein, 566 aa, Artificial Sequence; identical to SEQ ID NO: 2849
  hemagglutinin__InfluenzaA__ADN26175

SEQ ID NO: 5946 - protein, 566 aa, Artificial Sequence
  hemagglutinin__InfluenzaA__ADN78194
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGLLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 5947 - protein, 566 aa, Artificial Sequence; identical to SEQ ID NO: 3833
  hemagglutinin__InfluenzaA__ADN78195

SEQ ID NO: 5948 - protein, 566 aa, Artificial Sequence; identical to SEQ ID NO: 4221
  hemagglutinin__InfluenzaA__ADN78212

SEQ ID NO: 5949 - protein, 566 aa, Artificial Sequence; identical to SEQ ID NO: 4221
  hemagglutinin__InfluenzaA__ADN78221

SEQ ID NO: 5950 - protein, 565 aa, Artificial Sequence; identical to SEQ ID NO: 5940
  hemagglutinin__InfluenzaA__ADN89050

SEQ ID NO: 5951 - protein, 565 aa, Artificial Sequence
  hemagglutinin__InfluenzaA__ADN89061
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTEKNGLYPNLSKSYANNKEKEVLVLWGVHHPPSISDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINEITNKVNSVIEKMNTQFTAVGKEFNKLERRMENLNKKVDDGFIDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5952 - protein, 565 aa, Artificial Sequence; identical to SEQ ID NO: 5942
  hemagglutinin__InfluenzaA__ADN89072

SEQ ID NO: 5953 - protein, 565 aa, Artificial Sequence
  hemagglutinin__InfluenzaA__ADN89083
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNMADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5954 - protein, 565 aa, Artificial Sequence
  hemagglutinin__InfluenzaA__ADN89094
MKVKLLVLLCTFTATYADTICIGYHANNSTDTVDTALEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKGKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5955 - protein, 565 aa, Artificial Sequence
  hemagglutinin__InfluenzaA__ADN89116
MKVKLLILLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNNLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5956 - protein, 565 aa, Artificial Sequence
  hemagglutinin__InfluenzaA__ADN89127
MKVKLLVLLCTLTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKGSSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAEEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5957 - protein, 565 aa, Artificial Sequence
  hemagglutinin__InfluenzaA__ADN89149
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTEKNGLYPNLSKSYANNKEKEVLVLWGVHHPPSISDQKTLYHTENAYVSVVSSHYSRKFTPEVAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5958 - protein, 565 aa, Artificial Sequence; identical to SEQ ID NO: 5513
  hemagglutinin__InfluenzaA__ADN89171

SEQ ID NO: 5959 - protein, 565 aa, Artificial Sequence
  hemagglutinin__InfluenzaA__ADN89182
MKVKLLVLLCTLTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5960 - protein, 565 aa, Artificial Sequence; identical to SEQ ID NO: 5513
  hemagglutinin__InfluenzaA__ADN89193

SEQ ID NO: 5961 - protein, 565 aa, Artificial Sequence; identical to SEQ ID NO: 5513
  hemagglutinin__InfluenzaA__ADN89204

SEQ ID NO: 5962 - protein, 565 aa, Artificial Sequence; identical to SEQ ID NO: 5940
  hemagglutinin__InfluenzaA__ADN89215

SEQ ID NO: 5963 - protein, 565 aa, Artificial Sequence
  hemagglutinin__InfluenzaA__ADN89226
MKVKLLVLLCTFAATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTEKNGLYPNLSKSYANNKEKEVLVLWGVHHPPSISDQKTLYHTENAYVSVVSSHYSRKFTPEIAKRPKVRDQEGRINYYWTLLEPGDTIIFEANGNLIAPRYAFALNRGFGSGIINSNAPMDKCDAKCQTPQGAINSSLPFQNVHPVTIGECPKYVRSAKLRMVTGLRNIPSVQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5964 - protein, 565 aa, Artificial Sequence; identical to SEQ ID NO: 5940
  hemagglutinin__InfluenzaA__ADN89237

SEQ ID NO: 5965 - protein, 565 aa, Artificial Sequence
  hemagglutinin__InfluenzaA__ADN89248
MKVKLLVLLCTFTATYADTICIGYHANNSTDTVDTVLEKNVTVTHSVNLLENSHNGKLCLLKGIAPLQLGNCSIAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5966 - protein, 565 aa, Artificial Sequence; identical to SEQ ID NO: 5953
  hemagglutinin__InfluenzaA__ADN89259

SEQ ID NO: 5967 - protein, 565 aa, Artificial Sequence
  hemagglutinin__InfluenzaA__ADN89281
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTEKNGLYPNLSKSYANNKEKEVLVLWGVHHPPSISDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5968 - protein, 565 aa, Artificial Sequence; identical to SEQ ID NO: 5967
  hemagglutinin__InfluenzaA__ADN89292

SEQ ID NO: 5969 - protein, 565 aa, Artificial Sequence; identical to SEQ ID NO: 5967
  hemagglutinin__InfluenzaA__ADN89303

SEQ ID NO: 5970 - protein, 565 aa, Artificial Sequence; identical to SEQ ID NO: 3626
  hemagglutinin__InfluenzaA__ADN89314

SEQ ID NO: 5971 - protein, 565 aa, Artificial Sequence; identical to SEQ ID NO: 3131
  hemagglutinin__InfluenzaA__ADN89325

SEQ ID NO: 5972 - protein, 565 aa, Artificial Sequence
  hemagglutinin__InfluenzaA__ADN89336
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYRNLLWLTGKNGLYPNLSKSYANNKEKEVLVLWGVHHPPDIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5973 - protein, 565 aa, Artificial Sequence; identical to SEQ ID NO: 5963
  hemagglutinin__InfluenzaA__ADN89347

SEQ ID NO: 5974 - protein, 565 aa, Artificial Sequence; identical to SEQ ID NO: 3131
  hemagglutinin__InfluenzaA__ADN89358

SEQ ID NO: 5975 - protein, 565 aa, Artificial Sequence
  hemagglutinin__InfluenzaA__ADN89369
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFIPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5976 - protein, 565 aa, Artificial Sequence
  hemagglutinin__InfluenzaA__ADN89380
MKVKLLVLLCTLTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 5977 - protein, 565 aa, Artificial Sequence
  hemagglutinin__InfluenzaA__ADN89391
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYKNLLWLTGKNGLYPNLSKSYANNKEKEVLVLWGVHHPPDIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5978 - protein, 565 aa, Artificial Sequence
  hemagglutinin__InfluenzaA__ADN89402
MKVKLLVLLCTFTATYADTICIGYHANNSTDTVDTVLEKNVTVTHSVNLLENSHNGKLCLLKGIAPLQLGNCSVAGWILGNPECELLISKKSWSYIVEKPNPENGTCYPGHFADYEELKEQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5979 - protein, 565 aa, Artificial Sequence; identical to SEQ ID NO: 5940
  hemagglutinin__InfluenzaA__ADN89413

SEQ ID NO: 5980 - protein, 565 aa, Artificial Sequence; identical to SEQ ID NO: 5513
  hemagglutinin__InfluenzaA__ADN89424

SEQ ID NO: 5981 - protein, 565 aa, Artificial Sequence
  hemagglutinin__InfluenzaA__ADN89435
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESRLNREKIDGVKLESMGVYQILAIYSTVASSLVLLVSLGAISFWMCSNGSLQCRICI

SEQ ID NO: 5982 - protein, 565 aa, Artificial Sequence
  hemagglutinin__InfluenzaA__ADN89446
MKAKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5983 - protein, 565 aa, Artificial Sequence; identical to SEQ ID NO: 5513
  hemagglutinin__InfluenzaA__ADN89457

SEQ ID NO: 5984 - protein, 565 aa, Artificial Sequence
  hemagglutinin__InfluenzaA__ADN89468
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKDSSWPNHTVTGVSASCSHNGESSFYRNLLWLTGKNGLYPNLSKSYANNKEKEVLVLWGVHHPPSINDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILTIYSTVASSLVLLISLGAISFWMCSNGSLQCRICI

SEQ ID NO: 5985 - protein, 565 aa, Artificial Sequence; identical to SEQ ID NO: 5942
  hemagglutinin__InfluenzaA__ADN89479

SEQ ID NO: 5986 - protein, 565 aa, Artificial Sequence; identical to SEQ ID NO: 5942
  hemagglutinin__InfluenzaA__ADN89490

SEQ ID NO: 5987 - protein, 565 aa, Artificial Sequence; identical to SEQ ID NO: 5965
  hemagglutinin__InfluenzaA__ADN89501

SEQ ID NO: 5988 - protein, 565 aa, Artificial Sequence; identical to SEQ ID NO: 5953
  hemagglutinin__InfluenzaA__ADN89512

SEQ ID NO: 5989 - protein, 565 aa, Artificial Sequence; identical to SEQ ID NO: 5967
  hemagglutinin__InfluenzaA__ADN89523

SEQ ID NO: 5990 - protein, 565 aa, Artificial Sequence; identical to SEQ ID NO: 5976
  hemagglutinin__InfluenzaA__ADN89534

SEQ ID NO: 5991 - protein, 565 aa, Artificial Sequence; identical to SEQ ID NO: 5981
  hemagglutinin__InfluenzaA__ADN89545

SEQ ID NO: 5992 - protein, 565 aa, Artificial Sequence; identical to SEQ ID NO: 3626
  hemagglutinin__InfluenzaA__ADN89556

SEQ ID NO: 5993 - protein, 565 aa, Artificial Sequence; identical to SEQ ID NO: 5942
  hemagglutinin__InfluenzaA__ADN89567

SEQ ID NO: 5994 - protein, 565 aa, Artificial Sequence
  hemagglutinin__InfluenzaA__ADN89578
MKVKLLVLLCTLTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKGSSWPNHTVTGVSASCSHNGENSFYRNLLWLTGKNGLYPNLSKSYANNKEKEVLLLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5995 - protein, 565 aa, Artificial Sequence; identical to SEQ ID NO: 5513
  hemagglutinin__InfluenzaA__ADN89589

SEQ ID NO: 5996 - protein, 565 aa, Artificial Sequence
  hemagglutinin__InfluenzaA__ADN89600
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTRKNGLYPNLSKSYANNKEKEVLVLWGVHHPPNMVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 5997 - protein, 565 aa, Artificial Sequence; identical to SEQ ID NO: 5513
  hemagglutinin__InfluenzaA__ADN89611

SEQ ID NO: 5998 - protein, 565 aa, Artificial Sequence; identical to SEQ ID NO: 5940
  hemagglutinin__InfluenzaA__ADN89622

SEQ ID NO: 5999 - protein, 565 aa, Artificial Sequence; identical to SEQ ID NO: 5981
  hemagglutinin__InfluenzaA__ADN89633

SEQ ID NO: 6000 - protein, 565 aa, Artificial Sequence; identical to SEQ ID NO: 5965
  hemagglutinin__InfluenzaA__ADN89644

SEQ ID NO: 6001 - protein, 565 aa, Artificial Sequence; identical to SEQ ID NO: 5981
  hemagglutinin__InfluenzaA__ADN89655

SEQ ID NO: 6002 - protein, 565 aa, Artificial Sequence; identical to SEQ ID NO: 5513
  hemagglutinin__InfluenzaA__ADN89666

SEQ ID NO: 6003 - protein, 565 aa, Artificial Sequence; identical to SEQ ID NO: 5953
  hemagglutinin__InfluenzaA__ADN89677

SEQ ID NO: 6004 - protein, 565 aa, Artificial Sequence; identical to SEQ ID NO: 5953
  hemagglutinin__InfluenzaA__ADN89688

SEQ ID NO: 6005 - protein, 565 aa, Artificial Sequence; identical to SEQ ID NO: 5940
  hemagglutinin__InfluenzaA__ADN89699

SEQ ID NO: 6006 - protein, 565 aa, Artificial Sequence; identical to SEQ ID NO: 5942
  hemagglutinin__InfluenzaA__ADN89710

SEQ ID NO: 6007 - protein, 565 aa, Artificial Sequence; identical to SEQ ID NO: 5965
  hemagglutinin__InfluenzaA__ADN89721

SEQ ID NO: 6008 - protein, 565 aa, Artificial Sequence; identical to SEQ ID NO: 5942
  hemagglutinin__InfluenzaA__ADN89732

SEQ ID NO: 6009 - protein, 565 aa, Artificial Sequence; identical to SEQ ID NO: 5942
  hemagglutinin__InfluenzaA__ADN89743

SEQ ID NO: 6010 - protein, 565 aa, Artificial Sequence; identical to SEQ ID NO: 5967
  hemagglutinin__InfluenzaA__ADN89765

SEQ ID NO: 6011 - protein, 565 aa, Artificial Sequence
  hemagglutinin__InfluenzaA__ADN89776
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISDQKTLYHTENAYVSVVSSHYSRKFTPEVAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6012 - protein, 565 aa, Artificial Sequence; identical to SEQ ID NO: 5953
  hemagglutinin__InfluenzaA__ADN89787

SEQ ID NO: 6013 - protein, 565 aa, Artificial Sequence; identical to SEQ ID NO: 5967
  hemagglutinin__InfluenzaA__ADN89798

SEQ ID NO: 6014 - protein, 565 aa, Artificial Sequence; identical to SEQ ID NO: 5513
  hemagglutinin__InfluenzaA__ADN89809

SEQ ID NO: 6015 - protein, 565 aa, Artificial Sequence; identical to SEQ ID NO: 5513
  hemagglutinin__InfluenzaA__ADN89820

SEQ ID NO: 6016 - protein, 565 aa, Artificial Sequence; identical to SEQ ID NO: 5513
  hemagglutinin__InfluenzaA__ADN89831

SEQ ID NO: 6017 - protein, 565 aa, Artificial Sequence
  hemagglutinin__InfluenzaA__ADN89842
MKVKLLVLLCTFTATYADTICIGYHANNSTDTVDTVLEKNVTVTHSVNLLENRHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6018 - protein, 566 aa, Artificial Sequence; identical to SEQ ID NO: 5533
  hemagglutinin__InfluenzaA__ADN89864

SEQ ID NO: 6019 - protein, 566 aa, Artificial Sequence; identical to SEQ ID NO: 5533
  hemagglutinin__InfluenzaA__ADN89875

SEQ ID NO: 6020 - protein, 566 aa, Artificial Sequence
  hemagglutinin__InfluenzaA__ADN89886
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTRKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 6021 - protein, 566 aa, Artificial Sequence; identical to SEQ ID NO: 5533
  hemagglutinin__InfluenzaA__ADN89897

SEQ ID NO: 6022 - protein, 566 aa, Artificial Sequence; identical to SEQ ID NO: 5533
  hemagglutinin__InfluenzaA__ADN89908

SEQ ID NO: 6023 - protein, 566 aa, Artificial Sequence; identical to SEQ ID NO: 5533
  hemagglutinin__InfluenzaA__ADN89919

SEQ ID NO: 6024 - protein, 566 aa, Artificial Sequence; identical to SEQ ID NO: 5533
  hemagglutinin__InfluenzaA__ADN89930

SEQ ID NO: 6025 - protein, 566 aa, Artificial Sequence; identical to SEQ ID NO: 5533
  hemagglutinin__InfluenzaA__ADN89941

SEQ ID NO: 6026 - protein, 566 aa, Artificial Sequence; identical to SEQ ID NO: 5533
  hemagglutinin__InfluenzaA__ADN89952

SEQ ID NO: 6027 - protein, 566 aa, Artificial Sequence; identical to SEQ ID NO: 5533
  hemagglutinin__InfluenzaA__ADN89963

SEQ ID NO: 6028 - protein, 566 aa, Artificial Sequence
  hemagglutinin__InfluenzaA__ADN89974
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 6029 - protein, 566 aa, Artificial Sequence; identical to SEQ ID NO: 5533
  hemagglutinin__InfluenzaA__ADN89985

SEQ ID NO: 6030 - protein, 566 aa, Artificial Sequence; identical to SEQ ID NO: 5533
  hemagglutinin__InfluenzaA__ADN89996

SEQ ID NO: 6031 - protein, 566 aa, Artificial Sequence; identical to SEQ ID NO: 5533
  hemagglutinin__InfluenzaA__ADN90007

SEQ ID NO: 6032 - protein, 566 aa, Artificial Sequence; identical to SEQ ID NO: 5533
  hemagglutinin__InfluenzaA__ADN90018

SEQ ID NO: 6033 - protein, 566 aa, Artificial Sequence; identical to SEQ ID NO: 5533
  hemagglutinin__InfluenzaA__ADN90040

SEQ ID NO: 6034 - protein, 566 aa, Artificial Sequence; identical to SEQ ID NO: 5533
  hemagglutinin__InfluenzaA__ADN90051

SEQ ID NO: 6035 - protein, 566 aa, Artificial Sequence; identical to SEQ ID NO: 5533
  hemagglutinin__InfluenzaA__ADN90062

SEQ ID NO: 6036 - protein, 566 aa, Artificial Sequence; identical to SEQ ID NO: 5533
  hemagglutinin__InfluenzaA__ADN90073

SEQ ID NO: 6037 - protein, 566 aa, Artificial Sequence; identical to SEQ ID NO: 5533
  hemagglutinin__InfluenzaA__ADN90084

SEQ ID NO: 6038 - protein, 566 aa, Artificial Sequence; identical to SEQ ID NO: 5533
  hemagglutinin__InfluenzaA__ADN90095

SEQ ID NO: 6039 - protein, 566 aa, Artificial Sequence; identical to SEQ ID NO: 5533
  hemagglutinin__InfluenzaA__ADN90106

SEQ ID NO: 6040 - protein, 566 aa, Artificial Sequence; identical to SEQ ID NO: 5533
  hemagglutinin__InfluenzaA__ADN90117

SEQ ID NO: 6041 - protein, 566 aa, Artificial Sequence; identical to SEQ ID NO: 5533
  hemagglutinin__InfluenzaA__ADN90128

SEQ ID NO: 6042 - protein, 566 aa, Artificial Sequence; identical to SEQ ID NO: 5533
  hemagglutinin__InfluenzaA__ADN90139

SEQ ID NO: 6043 - protein, 566 aa, Artificial Sequence; identical to SEQ ID NO: 5533
  hemagglutinin__InfluenzaA__ADN90150

SEQ ID NO: 6044 - protein, 566 aa, Artificial Sequence; identical to SEQ ID NO: 5533
  hemagglutinin__InfluenzaA__ADN90161

SEQ ID NO: 6045 - protein, 566 aa, Artificial Sequence; identical to SEQ ID NO: 5533
  hemagglutinin__InfluenzaA__ADN90172

SEQ ID NO: 6046 - protein, 566 aa, Artificial Sequence; identical to SEQ ID NO: 5533
  hemagglutinin__InfluenzaA__ADN90183

SEQ ID NO: 6047 - protein, 566 aa, Artificial Sequence; identical to SEQ ID NO: 5533
  hemagglutinin__InfluenzaA__ADN90194

SEQ ID NO: 6048 - protein, 566 aa, Artificial Sequence; identical to SEQ ID NO: 5533
  hemagglutinin__InfluenzaA__ADN90205

SEQ ID NO: 6049 - protein, 566 aa, Artificial Sequence; identical to SEQ ID NO: 5533
  hemagglutinin__InfluenzaA__ADN90216

SEQ ID NO: 6050 - protein, 566 aa, Artificial Sequence; identical to SEQ ID NO: 3430
  hemagglutinin__InfluenzaA__ADN92467

SEQ ID NO: 6051 - protein, 566 aa, Artificial Sequence
  hemagglutinin__InfluenzaA__ADN92478
MKTIIALSHILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYQALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6052 - protein, 566 aa, Artificial Sequence
  hemagglutinin__InfluenzaA__ADN92489
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNENFNWTGVTQNGTSSACIRRSKNSFFSRLNWLTHLNFKYQALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6053 - protein, 566 aa, Artificial Sequence; identical to SEQ ID NO: 3430
  hemagglutinin__InfluenzaA__ADN92500

SEQ ID NO: 6054 - protein, 566 aa, Artificial Sequence; identical to SEQ ID NO: 2669
  hemagglutinin__InfluenzaA__ADN92510

SEQ ID NO: 6055 - protein, 566 aa, Artificial Sequence; identical to SEQ ID NO: 2669
  hemagglutinin__InfluenzaA__ADN92520

SEQ ID NO: 6056 - protein, 566 aa, Artificial Sequence; identical to SEQ ID NO: 3771
  hemagglutinin__InfluenzaA__ADN92530

SEQ ID NO: 6057 - protein, 566 aa, Artificial Sequence; identical to SEQ ID NO: 2911
  hemagglutinin__InfluenzaA__ADN92540

SEQ ID NO: 6058 - protein, 566 aa, Artificial Sequence; identical to SEQ ID NO: 2669
  hemagglutinin__InfluenzaA__ADN92550

SEQ ID NO: 6059 - protein, 566 aa, Artificial Sequence; identical to SEQ ID NO: 2669
  hemagglutinin__InfluenzaA__ADN92560

SEQ ID NO: 6060 - protein, 566 aa, Artificial Sequence
  hemagglutinin__InfluenzaA__ADO00730
MKAILVVLLYTFATANADTLCIGYHANNSTDTVDTVLEKNVTVTHSVNLLEDKHNGKLCKLRGVAPLHLGKCNIAGWILGNPECGSLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6061 - protein, 566 aa, Artificial Sequence; identical to SEQ ID NO: 4089
  hemagglutinin__InfluenzaA__ADO00740

SEQ ID NO: 6062 - protein, 566 aa, Artificial Sequence; identical to SEQ ID NO: 3833
  hemagglutinin__InfluenzaA__ADO00750

SEQ ID NO: 6063 - protein, 566 aa, Artificial Sequence; identical to SEQ ID NO: 2669
  hemagglutinin__InfluenzaA__ADO12143

SEQ ID NO: 6064 - protein, 566 aa, Artificial Sequence; identical to SEQ ID NO: 2669
  hemagglutinin__InfluenzaA__ADO12153

SEQ ID NO: 6065 - protein, 566 aa, Artificial Sequence; identical to SEQ ID NO: 2669
  hemagglutinin__InfluenzaA__ADO12163

SEQ ID NO: 6066 - protein, 566 aa, Artificial Sequence; identical to SEQ ID NO: 2669
  hemagglutinin__InfluenzaA__ADO12173

SEQ ID NO: 6067 - protein, 566 aa, Artificial Sequence; identical to SEQ ID NO: 2669
  hemagglutinin__InfluenzaA__ADO12183

SEQ ID NO: 6068 - protein, 566 aa, Artificial Sequence; identical to SEQ ID NO: 2669
  hemagglutinin__InfluenzaA__ADO12193

SEQ ID NO: 6069 - protein, 566 aa, Artificial Sequence; identical to SEQ ID NO: 2669
  hemagglutinin__InfluenzaA__ADO12203

SEQ ID NO: 6070 - protein, 566 aa, Artificial Sequence; identical to SEQ ID NO: 2669
  hemagglutinin__InfluenzaA__ADO12213

SEQ ID NO: 6071 - protein, 566 aa, Artificial Sequence; identical to SEQ ID NO: 2669
  hemagglutinin__InfluenzaA__ADO12223

SEQ ID NO: 6072 - protein, 566 aa, Artificial Sequence; identical to SEQ ID NO: 2669
  hemagglutinin__InfluenzaA__ADO12233

SEQ ID NO: 6073 - protein, 566 aa, Artificial Sequence; identical to SEQ ID NO: 2669
  hemagglutinin__InfluenzaA__ADO12243

SEQ ID NO: 6074 - protein, 566 aa, Artificial Sequence; identical to SEQ ID NO: 2669
  hemagglutinin__InfluenzaA__ADO12253

SEQ ID NO: 6075 - protein, 566 aa, Artificial Sequence; identical to SEQ ID NO: 2669
  hemagglutinin__InfluenzaA__ADO12263

SEQ ID NO: 6076 - protein, 566 aa, Artificial Sequence; identical to SEQ ID NO: 2669
  hemagglutinin__InfluenzaA__ADO12273

SEQ ID NO: 6077 - protein, 566 aa, Artificial Sequence; identical to SEQ ID NO: 2669
  hemagglutinin__InfluenzaA__ADO12283

SEQ ID NO: 6078 - protein, 566 aa, Artificial Sequence; identical to SEQ ID NO: 2669
  hemagglutinin__InfluenzaA__ADO12293

SEQ ID NO: 6079 - protein, 566 aa, Artificial Sequence; identical to SEQ ID NO: 2669
  hemagglutinin__InfluenzaA__ADO12303

SEQ ID NO: 6080 - protein, 566 aa, Artificial Sequence; identical to SEQ ID NO: 2669
  hemagglutinin__InfluenzaA__ADO12313

SEQ ID NO: 6081 - protein, 566 aa, Artificial Sequence; identical to SEQ ID NO: 2669
  hemagglutinin__InfluenzaA__ADO12323

SEQ ID NO: 6082 - protein, 566 aa, Artificial Sequence; identical to SEQ ID NO: 2669
  hemagglutinin__InfluenzaA__ADO12333

SEQ ID NO: 6083 - protein, 566 aa, Artificial Sequence; identical to SEQ ID NO: 2669
  hemagglutinin__InfluenzaA__ADO12343

SEQ ID NO: 6084 - protein, 566 aa, Artificial Sequence; identical to SEQ ID NO: 2669
  hemagglutinin__InfluenzaA__ADO12353

SEQ ID NO: 6085 - protein, 566 aa, Artificial Sequence; identical to SEQ ID NO: 2669
  hemagglutinin__InfluenzaA__ADO12363

SEQ ID NO: 6086 - protein, 566 aa, Artificial Sequence
  hemagglutinin__InfluenzaA__ADO12373
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINNKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6087 - protein, 566 aa, Artificial Sequence; identical to SEQ ID NO: 4154
  hemagglutinin__InfluenzaA__ADO12383

SEQ ID NO: 6088 - protein, 566 aa, Artificial Sequence
  hemagglutinin__InfluenzaA__ADO12403
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6089 - protein, 566 aa, Artificial Sequence; identical to SEQ ID NO: 4305
  hemagglutinin__InfluenzaA__ADO12413

SEQ ID NO: 6090 - protein, 566 aa, Artificial Sequence; identical to SEQ ID NO: 2669
  hemagglutinin__InfluenzaA__ADO12423

SEQ ID NO: 6091 - protein, 566 aa, Artificial Sequence; identical to SEQ ID NO: 2669
  hemagglutinin__InfluenzaA__ADO12433

SEQ ID NO: 6092 - protein, 566 aa, Artificial Sequence; identical to SEQ ID NO: 2669
  hemagglutinin__InfluenzaA__ADO12443

SEQ ID NO: 6093 - protein, 566 aa, Artificial Sequence; identical to SEQ ID NO: 2669
  hemagglutinin__InfluenzaA__ADO12453

SEQ ID NO: 6094 - protein, 566 aa, Artificial Sequence; identical to SEQ ID NO: 2669
  hemagglutinin__InfluenzaA__ADO12463

SEQ ID NO: 6095 - protein, 566 aa, Artificial Sequence
  hemagglutinin__InfluenzaA__ADO12473
MKAILVVLLYTFATANADTLCIGYHANNSTDTVDTVLEKNVTVTHSVNLLEDKQNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6096 - protein, 566 aa, Artificial Sequence; identical to SEQ ID NO: 2669
  hemagglutinin__InfluenzaA__ADO12493

SEQ ID NO: 6097 - protein, 566 aa, Artificial Sequence
  hemagglutinin__InfluenzaA__ADO12503
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAINFWMCSNGSLQCRICI

SEQ ID NO: 6098 - protein, 566 aa, Artificial Sequence
  hemagglutinin__InfluenzaA__ADO12513
MKAILVVLLYTFATANADTLCIGYHANNSTDTVDTVLEKNVTVTHSVNLLEDKHNGKLCKLREVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6099 - protein, 566 aa, Artificial Sequence; identical to SEQ ID NO: 2669
  hemagglutinin__InfluenzaA__ADO12523

SEQ ID NO: 6100 - protein, 566 aa, Artificial Sequence
  hemagglutinin__InfluenzaA__ADO12533
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTRLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6101 - protein, 566 aa, Artificial Sequence; identical to SEQ ID NO: 2669
  hemagglutinin__InfluenzaA__ADO12543

SEQ ID NO: 6102 - protein, 566 aa, Artificial Sequence; identical to SEQ ID NO: 2669
  hemagglutinin__InfluenzaA__ADO12553

SEQ ID NO: 6103 - protein, 566 aa, Artificial Sequence; identical to SEQ ID NO: 2669
  hemagglutinin__InfluenzaA__ADO12563

SEQ ID NO: 6104 - protein, 566 aa, Artificial Sequence; identical to SEQ ID NO: 2669
  hemagglutinin__InfluenzaA__ADO12573

SEQ ID NO: 6105 - protein, 566 aa, Artificial Sequence
  hemagglutinin__InfluenzaA__ADO12593
MKAILVVLLYTFATANADTLCIGYHANNSTDIVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6106 - protein, 566 aa, Artificial Sequence; identical to SEQ ID NO: 2669
  hemagglutinin__InfluenzaA__ADO12603

SEQ ID NO: 6107 - protein, 566 aa, Artificial Sequence; identical to SEQ ID NO: 2669
  hemagglutinin__InfluenzaA__ADO12613

SEQ ID NO: 6108 - protein, 566 aa, Artificial Sequence; identical to SEQ ID NO: 2669
  hemagglutinin__InfluenzaA__ADO12623

SEQ ID NO: 6109 - protein, 566 aa, Artificial Sequence
  hemagglutinin__InfluenzaA__ADO14349
MKAILVVLLYTFATANADTLCIGYHANNSTDTVDTVLEKNVTVTHSVNLLEDKHKGKLCKLRGVAPLHLGKCNIAGWILGNPECESLSTASSWSYIVETSSSDKGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6110 - protein, 566 aa, Artificial Sequence; identical to SEQ ID NO: 4933
  hemagglutinin__InfluenzaA__ADO14351

SEQ ID NO: 6111 - protein, 566 aa, Artificial Sequence
  hemagglutinin__InfluenzaA__ADO14353
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAEAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6112 - protein, 566 aa, Artificial Sequence
  hemagglutinin__InfluenzaA__ADO14354
MKAILVVLLYTFATANADTLCMGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6113 - protein, 566 aa, Artificial Sequence
  hemagglutinin__InfluenzaA__ADO14356
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPEYSEEAKLNREEIDGVKLESTRIYQILAIYSTVASSLVLVVSLGAISFWMCSNGSLQCRICI

SEQ ID NO: 6114 - protein, 566 aa, Artificial Sequence; identical to SEQ ID NO: 4933
  hemagglutinin__InfluenzaA__ADO14357

SEQ ID NO: 6115 - protein, 566 aa, Artificial Sequence
  hemagglutinin__InfluenzaA__ADO14359
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6116 - protein, 566 aa, Artificial Sequence
  hemagglutinin__InfluenzaA__ADO14361
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDKGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6117 - protein, 566 aa, Artificial Sequence
  hemagglutinin__InfluenzaA__ADO14362
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSNSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6118 - protein, 560 aa, Artificial Sequence
  hemagglutinin__InfluenzaA__ADO21015
MEVVSLITILLLVTVSNADKICIGYQSTNSTETVDTLTENNVPVAHAKELLHTEHNGMLCATNLGHPLILDTCTIEGLIYGNPSCDLLLGGREWSYIVERPSAVNGLCYPGNVENLEELRSLFSSASSYQRIQIFPGTIWNVSYGGTSKACSDSFYKSMRWLTQKNNAYPIQDAQYTNNRGKNILFMWGINHPPTDTTQTNLYTRTDTTTSVATEDINRTFKPLIGPRPLVNGQQGRIDYYWSVLKPGQTLRVRSNGNLIAPWYGHILSGESHGRILKTDLNSGNCVVQCQTERGGLNTTLPFHNVSKYAFGNCPKYVGVKSLKLAVGLRNVPARSSRGLFGAIAGFIEGGWSGLVAGWYGFQHSNDQGVGMAADRDSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYKEESRLERQKIEGVKLESEGTYKILTIYSTVASSLVIAMGFAAFLFWAMSNGSCRCNICI

SEQ ID NO: 6119 - protein, 560 aa, Artificial Sequence
  hemagglutinin__InfluenzaA__ADO21026
MEVVSLITILLLVTVSNADKICIGYQSTNSTETVDTLTENNVPVAHAKELLHTEHNGMLCATNLGHPLILDTCTIEGLIYGNPSCDLLLGGREWSYIVERPSAVNGLCYPGNVENLEELRSLFSSASSYQRIQIFPGTIWNVSYGGTSKACSDSFYKSMRWLTQKNNAYPIQDAQYTNNRGKNILFMWGINHPPTDTTQTNLYTRTDTTTSVATEDINRTFNPLIGPRPLVNGQQGRIDYYWSVLKPGQTLRVRSNGNLIAPWYGHILSGESHGRILKTDLNSGNCVVQCQTERGGLNTTLPFHNVSKYAFGNCPKYVGVKSLKLAVGLRNVPARSSRGLFGAIAGFIEGGWSGLVAGWYGFQHSNDQGVGMAADRDSTQKAIDKITSKVNNIVDKMNKQYEIIDHEFSEVETRLNIINNKIDDQIQDIWAYNAELLVLLENQKTLDEHDANVNNLYNKVKRALGSNAVEDGKGCFELYHKCDDQCMETIRNGTYNRRKYKEESRLERQKIEGVKLESEGTYKILTIYSTVASSLVIAMGFAAFLFWAMSNGSCRCNICI

SEQ ID NO: 6120 - protein, 560 aa, Artificial Sequence
  hemagglutinin__InfluenzaA__ADO21037
MEVVSLITILLLVTVSNADKICIGYQSTNSTETVDTLTENNVPVAHAKELLHTEHNGMLCATNLGHPLILDTCTIEGLIYGNPSCDLLLGGREWSYIVERPSAVNGLCYPGNVENLEELRSLFSSASSYQRIQIFPGTIWNVSYGGTSKACSDSFYKSMRWLTQKNNAYPIQDAQYTNNRGKNILFMWGINHPPTDTTQTNLYTRTDTTTSVATEDINRTFKPYIGPRPLVNGQQGRIDYYWSVLKPGQTLRVRSNGNLIAPWYGHILSGESHGRILKTDLNSGNCVVQCQTERGGLNTTLPFHNVSKYAFGNCPKYVGVKSLKLAVGLRNVPARSSRGLFGAIAGFIEGGWSGLVAGWYGFQHSNDQGVGMAADRDLTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYKEESRLERQKIEGVKLESEGTYKILTIYSTVASSLVIAMGFAAFLFWAMSNGSCRCNICI

SEQ ID NO: 6121 - protein, 560 aa, Artificial Sequence
  hemagglutinin__InfluenzaA__ADO21048
MEVVSLITILLLVTVSNADKICIGYQSTNSTETVDTLTENNVPVAHAKELLHTEHNGMLCATNLGHPLILDTCTIEGLIYGNPSCDLLLGGREWSYIVERPSAVNGLCYPGNVENLEELRSLFSSASSYQRIQIFPGTIWNVSYGGTSKACSDSFYKSMRWLTQKNNAYPIQDAQYTNNRGKNIHFMWGINHPPTDTTQTNLYTRTDTTTSVATEDINRTFKPLIGPRPLVNGQQGRIDYYWSVLKPGQTLRVRSNGNLIAPWYGHILSGESHGRILKTDLNSGNCVVQCQTERGGLNTTLPFHNVSKYAFGNCPKYVGVKSLKLAVGLRNVPARSSRGLFGAIAGFIEGGWSGLVAGWYGFQHSNDQGVGMAADRVSTQKAIDKITSKVNNIVDKMNKQYEIIDHEFSEVETRLNMINNKIDDQIQDIWAYNAELLVLLENQKTLDEHDANVNNLYNKVKRALGSNAVEDGKGCFELYHKCDDQCMETIRNGTYNRRKYKEESRLERQKIEGVKLESEGTYKILTIYSTVASSLVIAMGFAAFLFWAMSNGSCRCNICI

SEQ ID NO: 6122 - protein, 566 aa, Artificial Sequence
  hemagglutinin__InfluenzaA__ADO25092
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSNSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6123 - protein, 566 aa, Artificial Sequence; identical to SEQ ID NO: 4541
  hemagglutinin__InfluenzaA__ADO25112

SEQ ID NO: 6124 - protein, 566 aa, Artificial Sequence; identical to SEQ ID NO: 4541
  hemagglutinin__InfluenzaA__ADO25122

SEQ ID NO: 6125 - protein, 566 aa, Artificial Sequence
  hemagglutinin__InfluenzaA__ADO25132
MNAILVVLLYTFATANADTLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSDIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKINSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6126 - protein, 566 aa, Artificial Sequence; identical to SEQ ID NO: 4282
  hemagglutinin__InfluenzaA__ADO25142

SEQ ID NO: 6127 - protein, 566 aa, Artificial Sequence
  hemagglutinin__InfluenzaA__ADO25152
MKAILVVLLYTFAAANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSLFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6128 - protein, 566 aa, Artificial Sequence; identical to SEQ ID NO: 4221
  hemagglutinin__InfluenzaA__ADO25162

SEQ ID NO: 6129 - protein, 566 aa, Artificial Sequence; identical to SEQ ID NO: 4221
  hemagglutinin__InfluenzaA__ADO25172

SEQ ID NO: 6130 - protein, 566 aa, Artificial Sequence; identical to SEQ ID NO: 4221
  hemagglutinin__InfluenzaA__ADO25182

SEQ ID NO: 6131 - protein, 566 aa, Artificial Sequence; identical to SEQ ID NO: 2669
  hemagglutinin__InfluenzaA__ADO25192

SEQ ID NO: 6132 - protein, 566 aa, Artificial Sequence; identical to SEQ ID NO: 2669
  hemagglutinin__InfluenzaA__ADO25202

SEQ ID NO: 6133 - protein, 566 aa, Artificial Sequence
  hemagglutinin__InfluenzaA__ADO25212
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKRKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6134 - protein, 566 aa, Artificial Sequence
  hemagglutinin__InfluenzaA__ADO25222
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6135 - protein, 566 aa, Artificial Sequence; identical to SEQ ID NO: 4282
  hemagglutinin__InfluenzaA__ADO25232

SEQ ID NO: 6136 - protein, 566 aa, Artificial Sequence; identical to SEQ ID NO: 4221
  hemagglutinin__InfluenzaA__ADO25242

SEQ ID NO: 6137 - protein, 566 aa, Artificial Sequence; identical to SEQ ID NO: 4299
  hemagglutinin__InfluenzaA__ADO25252

SEQ ID NO: 6138 - protein, 566 aa, Artificial Sequence; identical to SEQ ID NO: 4541
  hemagglutinin__InfluenzaA__ADO25262

SEQ ID NO: 6139 - protein, 566 aa, Artificial Sequence
  hemagglutinin__InfluenzaA__ADO25272
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGVKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6140 - protein, 566 aa, Artificial Sequence; identical to SEQ ID NO: 4282
  hemagglutinin__InfluenzaA__ADO25282

SEQ ID NO: 6141 - protein, 565 aa, Artificial Sequence; identical to SEQ ID NO: 2488
  hemagglutinin__InfluenzaA__ADO27622

SEQ ID NO: 6142 - protein, 566 aa, Artificial Sequence; identical to SEQ ID NO: 2669
  hemagglutinin__InfluenzaA__ADO29887

SEQ ID NO: 6143 - protein, 566 aa, Artificial Sequence
  hemagglutinin__InfluenzaA__ADO29888
MKAILVVLLYTFATANADTLCIGYHANNSTDTVDTVLEKNVTVTHSVNLLEDKHNGKLCRLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6144 - protein, 566 aa, Artificial Sequence
  hemagglutinin__InfluenzaA__ADO29889
MKAILVVLLYTFATANADILCIGYHANNSTDTVDTVLEKNVTVTHSVNLLEDKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6145 - protein, 566 aa, Artificial Sequence
  hemagglutinin__InfluenzaA__ADO29890
MKAILVVLLYTFATAKADTLCIGYHANNSADTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSVDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6146 - protein, 566 aa, Artificial Sequence
  hemagglutinin__InfluenzaA__ADO29891
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKTTFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLSENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6147 - protein, 566 aa, Artificial Sequence
  hemagglutinin__InfluenzaA__ADO29892
MKAILVVLLYTFATAKADTLCIGYHANNSTDTVDTVLEKNVTVTHSVNLLEDKHNGKLCKLRGVAPLHLGKCNIAGRILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSVDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6148 - protein, 566 aa, Artificial Sequence; identical to SEQ ID NO: 3467
  hemagglutinin__InfluenzaA__ADO29893

SEQ ID NO: 6149 - protein, 566 aa, Artificial Sequence
  hemagglutinin__InfluenzaA__ADO29894
MKAILVVLLYTFATANADTLCIGYHANNSTDTVDTVLEMNVTVTHSVNLLEDKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGSSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6150 - protein, 566 aa, Artificial Sequence
  hemagglutinin__InfluenzaA__ADO29895
MKAILVALLYTFATANADTLCIGYHANNSTDTVDTVLEKNVTVTHSVNLLEDKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGSSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKGTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMERVKNGTYDYPKYSEEAKLNREEIDGVKLESTRIYQILAIYSTVASSLVLVVSLGAISFWMCSNGSLQCRICI

SEQ ID NO: 6151 - protein, 566 aa, Artificial Sequence
  hemagglutinin__InfluenzaA__ADO29897
MKAILVVLLYTFATANADILCIGYHANNSTDTVDTVLEKNVTVTHSVNLLEDKHNGKLCKLRGVAPLHLGKCNIAGWILGNPECESFSTSSSWSYIVETSSSDNGKCYPGDFIDYEELREQLSSVSSFERFEIFPKTSSWPNHDSNKGVTTACPHAGAKSFYKNLIWLVKKGNSYPRLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHGCNTTCQTPKGAINTSLPFQNIHPITIGKCPKYVKSTKLRLATGLRNVPSIQSRGLFGAVAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6152 - protein, 566 aa, Artificial Sequence; identical to SEQ ID NO: 3467
  hemagglutinin__InfluenzaA__ADO29898

SEQ ID NO: 6153 - protein, 566 aa, Artificial Sequence
  hemagglutinin__InfluenzaA__ADO29899
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRTCI

SEQ ID NO: 6154 - protein, 566 aa, Artificial Sequence
  hemagglutinin__InfluenzaA__ADO29900
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDLIDYEELREQLSSVSSFERFEIFPKTSSWPNHDLNKGVTAACPHAGAKSFYKNLIWLVKKGNSYPKLSKSYINDKGKEVLVLWGIHHPSTSADQQSLYQNADAYVFVGTSRYSKKSKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVRSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWAYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6155 - protein, 566 aa, Artificial Sequence
  hemagglutinin__InfluenzaA__ADO29901
MKAILVVLLYTFATANADTLCIGYHANNSTDTVDTVLEKNVTVTHSVNLLEDKHNEKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLAKKGNSYPKVSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCFNGSLQCRICI

SEQ ID NO: 6156 - protein, 566 aa, Artificial Sequence
  hemagglutinin__InfluenzaA__ADO29902
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMEGVKNGTYDYPKYSEEAKLNREEIDGVKLESTRIYQILAIYSTVASSLVLVVSLGAISFWMCSNGSLQCRICI

SEQ ID NO: 6157 - protein, 566 aa, Artificial Sequence
  hemagglutinin__InfluenzaA__ADO29903
MKAILVVLLYTFATANADTLCIGYHANNSTDTVDTVLEKNVTVTHSVNLLEDKHNGKLCKLRGVAPLHLGKCNTAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6158 - protein, 566 aa, Artificial Sequence
  hemagglutinin__InfluenzaA__ADO29904
MKAILVVLLYTFATANADTLCIGYHANNSTDTVDTVLEKNVTVTHSVNLLEDKHNGKLCKLRGVAPLHLGRCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHRPSTSADQQSLYQNADAYVFVGTSRYSKKFKPEIAIRPKVGDQEGRMNYYWTLVEPGDKITFEATGNLVVPRYAFAMERNAGSGIIISNTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6159 - protein, 566 aa, Artificial Sequence
  hemagglutinin__InfluenzaA__ADO29905
MKAILVVLLYTFATANADTLCIGYHANNSTDTVDTVLEKNVTVTRSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISNTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6160 - protein, 566 aa, Artificial Sequence
  hemagglutinin__InfluenzaA__ADO29906
MKAILVVLLYTFATANADTLCIGYHANNSTDTVDTVLEKNVTVTHSVNLLEDKHNRKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6161 - protein, 566 aa, Artificial Sequence
  hemagglutinin__InfluenzaA__ADO29907
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKLKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6162 - protein, 566 aa, Artificial Sequence
  hemagglutinin__InfluenzaA__ADO29908
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEWRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRVYQILATYSTVASSLVLVVSLGAISFWMCSNGSLQCRICI

SEQ ID NO: 6163 - protein, 566 aa, Artificial Sequence
  hemagglutinin__InfluenzaA__ADO29909
MKAILVVLLYTFATANADTLRIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSIQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLILVVSLGAISFWMCSNGSLQCRICI

SEQ ID NO: 6164 - protein, 566 aa, Artificial Sequence
  hemagglutinin__InfluenzaA__ADO29910
MKAILVVLLYTFATANADTLCIGYHANNSTDTVDTVLEKNVTVTHSVNLLEDKHNGKLCKPRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEAIGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNRGEIDGVKLESTRIYQILAIYSTVASSLVLVVSLGAISFWMCSNGSLQCRICI

SEQ ID NO: 6165 - protein, 566 aa, Artificial Sequence; identical to SEQ ID NO: 4391
  hemagglutinin__InfluenzaA__ADO30407

SEQ ID NO: 6166 - protein, 566 aa, Artificial Sequence; identical to SEQ ID NO: 4282
  hemagglutinin__InfluenzaA__ADO30417

SEQ ID NO: 6167 - protein, 566 aa, Artificial Sequence; identical to SEQ ID NO: 4004
  hemagglutinin__InfluenzaA__ADO33202

SEQ ID NO: 6168 - protein, 566 aa, Artificial Sequence; identical to SEQ ID NO: 3512
  hemagglutinin__InfluenzaA__ADO33240

SEQ ID NO: 6169 - protein, 566 aa, Artificial Sequence; identical to SEQ ID NO: 2669
  hemagglutinin__InfluenzaA__ADO33247

SEQ ID NO: 6170 - protein, 566 aa, Artificial Sequence; identical to SEQ ID NO: 3512
  hemagglutinin__InfluenzaA__ADO33254

SEQ ID NO: 6171 - protein, 566 aa, Artificial Sequence; identical to SEQ ID NO: 3512
  hemagglutinin__InfluenzaA__ADO33261

SEQ ID NO: 6172 - protein, 566 aa, Artificial Sequence; identical to SEQ ID NO: 3512
  hemagglutinin__InfluenzaA__ADO33269

SEQ ID NO: 6173 - protein, 566 aa, Artificial Sequence; identical to SEQ ID NO: 4004
  hemagglutinin__InfluenzaA__ADO33277

SEQ ID NO: 6174 - protein, 566 aa, Artificial Sequence; identical to SEQ ID NO: 3512
  hemagglutinin__InfluenzaA__ADO33285

SEQ ID NO: 6175 - protein, 566 aa, Artificial Sequence; identical to SEQ ID NO: 4004
  hemagglutinin__InfluenzaA__ADO33293

SEQ ID NO: 6176 - protein, 566 aa, Artificial Sequence; identical to SEQ ID NO: 4004
  hemagglutinin__InfluenzaA__ADO33307

SEQ ID NO: 6177 - protein, 566 aa, Artificial Sequence; identical to SEQ ID NO: 3512
  hemagglutinin__InfluenzaA__ADO33313

SEQ ID NO: 6178 - protein, 566 aa, Artificial Sequence; identical to SEQ ID NO: 5762
  hemagglutinin__InfluenzaA__ADO33329

SEQ ID NO: 6179 - protein, 566 aa, Artificial Sequence; identical to SEQ ID NO: 3512
  hemagglutinin__InfluenzaA__ADO33337

SEQ ID NO: 6180 - protein, 566 aa, Artificial Sequence; identical to SEQ ID NO: 3512
  hemagglutinin__InfluenzaA__ADO33345

SEQ ID NO: 6181 - protein, 566 aa, Artificial Sequence; identical to SEQ ID NO: 4004
  hemagglutinin__InfluenzaA__ADO33352

SEQ ID NO: 6182 - protein, 566 aa, Artificial Sequence; identical to SEQ ID NO: 2669
  hemagglutinin__InfluenzaA__ADO33360

SEQ ID NO: 6183 - protein, 566 aa, Artificial Sequence; identical to SEQ ID NO: 3512
  hemagglutinin__InfluenzaA__ADO33368

SEQ ID NO: 6184 - protein, 566 aa, Artificial Sequence; identical to SEQ ID NO: 3512
  hemagglutinin__InfluenzaA__ADO33376

SEQ ID NO: 6185 - protein, 566 aa, Artificial Sequence; identical to SEQ ID NO: 2656
  hemagglutinin__InfluenzaA__ADO33384

SEQ ID NO: 6186 - protein, 566 aa, Artificial Sequence; identical to SEQ ID NO: 2669
  hemagglutinin__InfluenzaA__ADO33391

SEQ ID NO: 6187 - protein, 566 aa, Artificial Sequence
  hemagglutinin__InfluenzaA__ADO79917
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6188 - protein, 566 aa, Artificial Sequence
  hemagglutinin__InfluenzaA__ADO79923
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSTDKWTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQERRMNYYWTLVQPGDKITFQATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6189 - protein, 566 aa, Artificial Sequence
  hemagglutinin__InfluenzaA__ADO79924
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSTDKWTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLIEPGDKITFEPTGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6190 - protein, 566 aa, Artificial Sequence
  hemagglutinin__InfluenzaA__ADO79925
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSTHEWTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEAPGNLVVPRYAFAMERNAGSGIIISDTPVHNCNTTCQTPKGAINTSLPFQNIHPIKIGKCSKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6191 - protein, 566 aa, Artificial Sequence
  hemagglutinin__InfluenzaA__ADO79926
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSTDKWTCYPGDFIDYEELREQLSSVSSFERFEIFPKTSSWPNHDSNKGVTAACPHAGAKSFYKNLIWLVKKGNSFSKLSKTYLNDKGKEVLVLWGIHHPSTSADQQSLYQNADAYVFVGTSRYSKKFKPEIAIRPKVRDQEGRMNYYWTLVEPGDKITFEATGNLVVPRYAFAMERNVGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEMKNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6192 - protein, 566 aa, Artificial Sequence
  hemagglutinin__InfluenzaA__ADO79927
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSTDKWTCYPGDFIDYEELREQLSSVSSFERFEIFPKTSSWPNHDSNKGVTAACPHAAAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSVQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEMKNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6193 - protein, 566 aa, Artificial Sequence
  hemagglutinin__InfluenzaA__ADO79928
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSTDKWTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6194 - protein, 566 aa, Artificial Sequence
  hemagglutinin__InfluenzaA__ADO79929
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSTDKWTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6195 - protein, 566 aa, Artificial Sequence
  hemagglutinin__InfluenzaA__ADO79930
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSTDKWTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDREGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6196 - protein, 566 aa, Artificial Sequence
  hemagglutinin__InfluenzaA__ADO84715
MKAILVVLLYTFATANAGTLCIGYHANNSTDTVDTVLEKNVTVTHSVNLLEDKHNGKLCKLRGVAPLHLGKCNIAGWILGNPECESLSTASSWSYIVETFSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6197 - protein, 566 aa, Artificial Sequence; identical to SEQ ID NO: 2849
  hemagglutinin__InfluenzaA__ADP95341

SEQ ID NO: 6198 - protein, 566 aa, Artificial Sequence; identical to SEQ ID NO: 2656
  hemagglutinin__InfluenzaA__ADP95351

SEQ ID NO: 6199 - protein, 566 aa, Artificial Sequence; identical to SEQ ID NO: 2656
  hemagglutinin__InfluenzaA__ADP95361

SEQ ID NO: 6200 - protein, 566 aa, Artificial Sequence; identical to SEQ ID NO: 2656
  hemagglutinin__InfluenzaA__ADP95371

SEQ ID NO: 6201 - protein, 566 aa, Artificial Sequence; identical to SEQ ID NO: 2656
  hemagglutinin__InfluenzaA__ADP95381

SEQ ID NO: 6202 - protein, 566 aa, Artificial Sequence; identical to SEQ ID NO: 2656
  hemagglutinin__InfluenzaA__ADP95391

SEQ ID NO: 6203 - protein, 566 aa, Artificial Sequence; identical to SEQ ID NO: 2911
  hemagglutinin__InfluenzaA__ADQ28007

SEQ ID NO: 6204 - protein, 566 aa, Artificial Sequence; identical to SEQ ID NO: 2669
  hemagglutinin__InfluenzaA__ADQ28008

SEQ ID NO: 6205 - protein, 566 aa, Artificial Sequence; identical to SEQ ID NO: 4520
  hemagglutinin__InfluenzaA__ADQ28009

SEQ ID NO: 6206 - protein, 566 aa, Artificial Sequence
  hemagglutinin__InfluenzaA__ADQ28010
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKSLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6207 - protein, 566 aa, Artificial Sequence; identical to SEQ ID NO: 2669
  hemagglutinin__InfluenzaA__ADQ28011

SEQ ID NO: 6208 - protein, 566 aa, Artificial Sequence; identical to SEQ ID NO: 2669
  hemagglutinin__InfluenzaA__ADQ28012

SEQ ID NO: 6209 - protein, 566 aa, Artificial Sequence; identical to SEQ ID NO: 2669
  hemagglutinin__InfluenzaA__ADQ28013

SEQ ID NO: 6210 - protein, 566 aa, Artificial Sequence; identical to SEQ ID NO: 2911
  hemagglutinin__InfluenzaA__ADQ28014

SEQ ID NO: 6211 - protein, 566 aa, Artificial Sequence; identical to SEQ ID NO: 2911
  hemagglutinin__InfluenzaA__ADQ28015

SEQ ID NO: 6212 - protein, 566 aa, Artificial Sequence; identical to SEQ ID NO: 2669
  hemagglutinin__InfluenzaA__ADQ28016

SEQ ID NO: 6213 - protein, 566 aa, Artificial Sequence; identical to SEQ ID NO: 2669
  hemagglutinin__InfluenzaA__ADQ28017

SEQ ID NO: 6214 - protein, 566 aa, Artificial Sequence; identical to SEQ ID NO: 4915
  hemagglutinin__InfluenzaA__ADQ28018

SEQ ID NO: 6215 - protein, 566 aa, Artificial Sequence; identical to SEQ ID NO: 2911
  hemagglutinin__InfluenzaA__ADQ28019

SEQ ID NO: 6216 - protein, 566 aa, Artificial Sequence
  hemagglutinin__InfluenzaA__ADQ28020
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6217 - protein, 566 aa, Artificial Sequence; identical to SEQ ID NO: 3863
  hemagglutinin__InfluenzaA__ADQ28021

SEQ ID NO: 6218 - protein, 566 aa, Artificial Sequence
  hemagglutinin__InfluenzaA__ADQ28022
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6219 - protein, 566 aa, Artificial Sequence; identical to SEQ ID NO: 2669
  hemagglutinin__InfluenzaA__ADQ28023

SEQ ID NO: 6220 - protein, 566 aa, Artificial Sequence; identical to SEQ ID NO: 2911
  hemagglutinin__InfluenzaA__ADQ28024

SEQ ID NO: 6221 - protein, 566 aa, Artificial Sequence; identical to SEQ ID NO: 2911
  hemagglutinin__InfluenzaA__ADQ28025

SEQ ID NO: 6222 - protein, 566 aa, Artificial Sequence; identical to SEQ ID NO: 3414
  hemagglutinin__InfluenzaA__ADQ28028

SEQ ID NO: 6223 - protein, 566 aa, Artificial Sequence; identical to SEQ ID NO: 4894
  hemagglutinin__InfluenzaA__ADQ28029

SEQ ID NO: 6224 - protein, 566 aa, Artificial Sequence
  hemagglutinin__InfluenzaA__ADQ28030
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6225 - protein, 566 aa, Artificial Sequence; identical to SEQ ID NO: 3863
  hemagglutinin__InfluenzaA__ADQ28031

SEQ ID NO: 6226 - protein, 566 aa, Artificial Sequence; identical to SEQ ID NO: 2911
  hemagglutinin__InfluenzaA__ADQ28032

SEQ ID NO: 6227 - protein, 566 aa, Artificial Sequence
  hemagglutinin__InfluenzaA__ADQ28034
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTIVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNRKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6228 - protein, 566 aa, Artificial Sequence
  hemagglutinin__InfluenzaA__ADQ28035
MKAILVVLLYTFATANADTLCIGYHANNSTDTVDTVLEKNVTVTHSVNLLEDKHNGKLCRLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6229 - protein, 566 aa, Artificial Sequence; identical to SEQ ID NO: 2669
  hemagglutinin__InfluenzaA__ADQ28036

SEQ ID NO: 6230 - protein, 566 aa, Artificial Sequence; identical to SEQ ID NO: 2669
  hemagglutinin__InfluenzaA__ADQ28037

SEQ ID NO: 6231 - protein, 566 aa, Artificial Sequence; identical to SEQ ID NO: 2911
  hemagglutinin__InfluenzaA__ADQ28038

SEQ ID NO: 6232 - protein, 566 aa, Artificial Sequence; identical to SEQ ID NO: 2669
  hemagglutinin__InfluenzaA__ADQ28039

SEQ ID NO: 6233 - protein, 566 aa, Artificial Sequence; identical to SEQ ID NO: 2911
  hemagglutinin__InfluenzaA__ADQ28040

SEQ ID NO: 6234 - protein, 566 aa, Artificial Sequence; identical to SEQ ID NO: 2911
  hemagglutinin__InfluenzaA__ADQ28041

SEQ ID NO: 6235 - protein, 566 aa, Artificial Sequence
  hemagglutinin__InfluenzaA__ADQ28043
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHDGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6236 - protein, 566 aa, Artificial Sequence; identical to SEQ ID NO: 2911
  hemagglutinin__InfluenzaA__ADQ28044

SEQ ID NO: 6237 - protein, 566 aa, Artificial Sequence
  hemagglutinin__InfluenzaA__ADQ28045
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACSHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6238 - protein, 566 aa, Artificial Sequence; identical to SEQ ID NO: 3139
  hemagglutinin__InfluenzaA__ADQ28047

SEQ ID NO: 6239 - protein, 566 aa, Artificial Sequence; identical to SEQ ID NO: 2669
  hemagglutinin__InfluenzaA__ADQ28048

SEQ ID NO: 6240 - protein, 566 aa, Artificial Sequence; identical to SEQ ID NO: 2911
  hemagglutinin__InfluenzaA__ADQ28049

SEQ ID NO: 6241 - protein, 566 aa, Artificial Sequence; identical to SEQ ID NO: 2669
  hemagglutinin__InfluenzaA__ADQ28050

SEQ ID NO: 6242 - protein, 566 aa, Artificial Sequence
  hemagglutinin__InfluenzaA__ADQ28051
MKAILVVLLYTFATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6243 - protein, 566 aa, Artificial Sequence; identical to SEQ ID NO: 2669
  hemagglutinin__InfluenzaA__ADQ28053

SEQ ID NO: 6244 - protein, 566 aa, Artificial Sequence; identical to SEQ ID NO: 2911
  hemagglutinin__InfluenzaA__ADQ28055

SEQ ID NO: 6245 - protein, 566 aa, Artificial Sequence
  hemagglutinin__InfluenzaA__ADQ28056
MEAILVVLLYTFATADADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6246 - protein, 566 aa, Artificial Sequence; identical to SEQ ID NO: 2669
  hemagglutinin__InfluenzaA__ADQ28057

SEQ ID NO: 6247 - protein, 566 aa, Artificial Sequence; identical to SEQ ID NO: 2669
  hemagglutinin__InfluenzaA__ADQ28058

SEQ ID NO: 6248 - protein, 566 aa, Artificial Sequence
  hemagglutinin__InfluenzaA__ADQ28059
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6249 - protein, 566 aa, Artificial Sequence; identical to SEQ ID NO: 2669
  hemagglutinin__InfluenzaA__ADQ28060

SEQ ID NO: 6250 - protein, 566 aa, Artificial Sequence
  hemagglutinin__InfluenzaA__ADQ28061
MKAILVVLLYTFATANADTLCIGYHANNSTDTVDTVLEKNVTVTHSVNLLEDKHNGKLCKLRGVAPLHLGRCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADANVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6251 - protein, 566 aa, Artificial Sequence
  hemagglutinin__InfluenzaA__ADQ28063
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRNQEGRMNYHWTLVKPGDKITFEATGNLVVPRYAFAVERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6252 - protein, 566 aa, Artificial Sequence; identical to SEQ ID NO: 3417
  hemagglutinin__InfluenzaA__ADQ28064

SEQ ID NO: 6253 - protein, 566 aa, Artificial Sequence
  hemagglutinin__InfluenzaA__ADQ28065
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSAGQQSLYQNADAYVFVGTSRYSKKFKPEIAIRPKVRDQEGRMNYYWTLVEPGDKITFEATGNLVVPRYAFAMERNAGSGIIISDTQVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6254 - protein, 566 aa, Artificial Sequence
  hemagglutinin__InfluenzaA__ADQ28066
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPRVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6255 - protein, 566 aa, Artificial Sequence
  hemagglutinin__InfluenzaA__ADQ28067
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 6256 - protein, 566 aa, Artificial Sequence
  hemagglutinin__InfluenzaA__ADQ28068
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGEKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6257 - protein, 566 aa, Artificial Sequence; identical to SEQ ID NO: 6255
  hemagglutinin__InfluenzaA__ADQ28069

SEQ ID NO: 6258 - protein, 566 aa, Artificial Sequence
  hemagglutinin__InfluenzaA__ADQ28070
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRRQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6259 - protein, 566 aa, Artificial Sequence
  hemagglutinin__InfluenzaA__ADQ28071
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6260 - protein, 566 aa, Artificial Sequence; identical to SEQ ID NO: 3613
  hemagglutinin__InfluenzaA__ADR32361

SEQ ID NO: 6261 - protein, 562 aa, Artificial Sequence
  hemagglutinin__InfluenzaA__ADT78887
MALIYLILLFTSVRGDQICIGYHANNSTEKVDTILERNVTVTHAKDILEKTHNGKLCKLNGIPPLELGDCSIAGWLLGNPECDRLLRVPEWSYIMEKENPKYSLCYPGSFNDYEELKHLISSVKHFEKVKILPKDGWTQHTTTGGSRACAVSGNPSFFRNMVWLTKKGPNYPVAKGSYNNTSGEQMLIIWGVHHPNDEAEQRALYQKVGTYVSASTSTLNKRSTPEIAARPEVNGLGSRMEFSWTLLDMWDTINFESTGNLVAPEYGFKISKRGSSGVMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLEKRLENLNKKMEDGFLDVWTYNAELLVLMENERTLDFHDSNVKNLYDKVRMQLRDNVKELGNGCFEFYHKCDDECMDSVKNGTYDYPKYEEESKLNRNEIKGVKLSSMGVYQILAIYATVAGSLSLAIMMAGISFWMCSNGSLQCRICI

SEQ ID NO: 6262 - protein, 566 aa, Artificial Sequence
  hemagglutinin__InfluenzaA__ADT78908
MKAKLLILLCALSATDADTICIGYHANNSTDTVDTVLEKNVTVTHSVNLLEDSHNGKLCRLKGKAPLQLGKCNIAGWVLGNPECESLLSNRSWSYIAETPNSENGTCYPGDFADYEELREQLSSVSSFERFEIFPKERSWPKHNTTRGVTAACSHARKSSFYKNLVWLTEANGSYPNLSKSYVNNQEKEVLVLWGVHHPSNIEDQRTLYRKDNAYVSVVSSNYNRRFTPEIAKRPKVRDQPGRMNYYWTLLEPGDTIIFEATGNLIAPWYAFALSRGPGSGIITSNAPMDECDTKCQTPQGAINSSLPFQNIHPVTIGECPKYVRSTKLRMVTGLRNIPSIQSRGLFGAIAGFIEGGWTGMMDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKELGNGCFEFYHKCDNECMESVKNGTYDYPKYSEESKLNREKIDGVKLESMGVYRILAIYSTVASSLVLLVSLGAISFWMCSNGSLQCRICI

SEQ ID NO: 6263 - protein, 566 aa, Artificial Sequence
  hemagglutinin__InfluenzaA__ADT78929
MKAKLLILLCALSATDADTICIGYHANNSTDTVDTVLEKNVTVTHSVNLLEDSHNGKLCRLKGIAPLQLGKCNIAGWILGNPECESLLSKRSWSYIAETPNSENGTCYPGDFADYEELREQLSSVSSFERFEIFPKERSWPKHNITRGVTAACSHAGKSSFYKNLLWLTETKGSYPNLSKSYVNNKEKEVLVLWGVHHPSNIEDQKTLYRKENAYVSVVSSNYNRRFTPEIAERPKVRGQAGRMNYYWTLLEPGDTIIFEANGNLIAPWYAFALSRGLGSGIITSNASMDECDTKCQTPQGAINSSLPFQNIHPVTIGECPKYVKSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 6264 - protein, 566 aa, Artificial Sequence
  hemagglutinin__InfluenzaA__ADT78936
MKAKLLVLLCALSATYADTICIGYHANNSTDTVDTVLEKNVTVTHSVNLLEDSHNGKLCRLKGKAPLQLGKCNIAGWILGNPECESLLSKRSWSYIAETPNSENGTCYPGDFADYEELREQLSSVSSFERFEIFPKESSWPKHNTTRGVTAACSHARKSSFYKNLLWLTEANGSYPNLSKSYVNNQEKEVLVLWGVHHPSNIEDQRTLYRKENAYVSVVSSNYNRRFTPEIAERPKVRNQAGRMNYYWTLLEPGDTIIFEANGNLIAPWYAFALSRGLGSGIITSNASMDECDTKCQTPQGAINSSLPFQNIHPVTIGECPKYVKSTKLRMVTGLRNIPSIQSRGLFGAIAGFIEGGWTGMMDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKELGNGCFEFYHKCDNECMESVKNGTYDYPKYSEESKLNREKIDGVKLESMGVYRILAIYSTVASSLVLLVSLGAISFWMCSNGSLQCRICI

SEQ ID NO: 6265 - protein, 562 aa, Artificial Sequence
  hemagglutinin__InfluenzaA__ADT78961
MAIICLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKNRWTQHTTTGGSRACAVSGNPSFFRNMVWLTKKGSNYPVAKGSYNNTSGEQMLIIWGVHHPNDETEQRTLYQNVETYVSVSTSTLNKRSTPKIATRPEVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGPRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILVIYATVAGSLSLAIMMAGISFWMCSNGSLQCRICI

SEQ ID NO: 6266 - protein, 566 aa, Artificial Sequence; identical to SEQ ID NO: 764
  hemagglutinin__InfluenzaA__ADT78971

SEQ ID NO: 6267 - protein, 566 aa, Artificial Sequence; identical to SEQ ID NO: 305
  hemagglutinin__InfluenzaA__ADT79010

SEQ ID NO: 6268 - protein, 566 aa, Artificial Sequence; identical to SEQ ID NO: 764
  hemagglutinin__InfluenzaA__ADT79030

SEQ ID NO: 6269 - protein, 566 aa, Artificial Sequence; identical to SEQ ID NO: 1342
  hemagglutinin__InfluenzaA__ADT79050

SEQ ID NO: 6270 - protein, 566 aa, Artificial Sequence
  hemagglutinin__InfluenzaA__ADT79108
MKARLLILLCALSATDADTICIGYHANNSTDTVDTVLEKNVTVTHSVNLLEDSHNGKLCRLKGIAPLQLGKCNIAGWILGNPECESLLSNRSWSYIAETPNSENGTCYPGDFADYEELREQLSSVSSFERFEIFPKERSWPKHNITRGVTAACSHAKKSSFYKNLLWLTEANGSYPNLIKSYVNNKEKEVLVLWGVHHPSNIEDQRTLYRKENAYVSVVSSNYNRRFTPEIAERPKVRGQAGRMNYYWTLLEPGDKIIFEANGNLIAPWYAFALSRGLGSGIITSNASMDECDTKCQTPQGAINSSLPFQNIHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCDNECMESVKNGTYDYPKYSEESKLNREKIDGVKLESMGVYQILAIYSTVASSLVLLVSLGAISFWMCSNGSLQCRICI

SEQ ID NO: 6271 - protein, 562 aa, Artificial Sequence
  hemagglutinin__InfluenzaA__ADT79119
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGLGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 6272 - protein, 562 aa, Artificial Sequence
  hemagglutinin__InfluenzaA__ADT79129
MAIIYLILLFTAVRGDQICIGYHANNSTEKVDTILERNVTVTHAKDILEKTHNGKLCKLNGIPPLELGDCSIAGWLLGNPECDRLLRVPEWSYIMEKENPRDGLCYPGSFNDYEELKHLLSSVKHFEKVKILPKDRWTQHTTTGGSRACAVSGNPSFFRNMIWLTKKGSNYPVAKGSYNNTSGEQMLIIWGVHHPNDETEQRTLYQNVGTYVSVVTSTLNKRSTPKIATRPKVNGLGGRMEFSWTLLDMWDTINFESTGNLIAPEYGFKISKRGSSGIMKTEGTLENCETKCQTPLGAINTTLPFHNVHPLAIGECPKYVKSEKLVLATGLRNVPQIESRGLFGAIAGFIEGGWQGMVDGWYGYHHSNDQGSGYAADKESTQRAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 6273 - protein, 566 aa, Artificial Sequence
  hemagglutinin__InfluenzaA__ADT79232
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNKHPITIGKCPKYVKSTKLRLATGLRNVPSIQSRGLFGAIAGFIEGGWTGMVDGWYGYHHQNEQGSGYAADVKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6274 - protein, 566 aa, Artificial Sequence
  hemagglutinin__InfluenzaA__ADT79242
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6275 - protein, 566 aa, Artificial Sequence
  hemagglutinin__InfluenzaA__ADT91182
MKAILVVLLYTFATANADTLCIGYHANNSTDTVDTVLEKNVTVTHSVNLLEDKHNGKLCKLRGVAPLHLGKCNIAGWILGNPECEPLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6276 - protein, 566 aa, Artificial Sequence
  hemagglutinin__InfluenzaA__ADU20561
MKAILVVLLYTFATANADTLCIGYHANNSTDTVDTVLEKNVTVTHSVNLLEDKHNGKLCKLGGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6277 - protein, 566 aa, Artificial Sequence
  hemagglutinin__InfluenzaA__ADU20562
MKAILVVLLYTFATANADTLCIGYHANNSTDTVDTVLEKNVTVTHSVNLLEDKHNGKLCKLRGVAPLHLGKCKIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6278 - protein, 566 aa, Artificial Sequence
  hemagglutinin__InfluenzaA__ADU25478
MEAKLFVLFCAFTALKADTICVGYHANNSTDTVDTILERNVTVTHSVNLLESSHNGKLCSLNGKAPLQLGNCNVAGWILGNPECDLLLTVNSWSYIIETSTSKNGACYPGEFADYEELREQLSTVSSFERFEIFPKATSWPNHETTKGTTVACSHSGANSFYRNLLWIVKKGNSYPKLSKSYTNNKGKEVLVIWGVHHPPTDSDQQTLYQNNHTYVSVGSSKYYQRFTPEIVTRPKVREQAGRMNYYWTLLDQGDTITFEATGNLIAPWHAFALNKGSSSGIMMSDAHVHNCTTKCQTPHGALKSNLPFQNVHPITIGECPKYVKSTQLRMATGLRNIPSIQSRGLFGAIAGFIEGGWTGMIDGWYGYHHQNEQGSGYAADQKSTQIAIDGISNKVNSVIEKMNVQFTSVGKEFNNLEKRIENLNKKVDDGFLDIWTYNAELLILLENERTLDFHDFNVKNLYERVKSQLRNNAKEIGNGCFEFYHKCNNECMESVKNGTYNYPRYSEESKLNREEIDGVKLESVGVHQILAIYSTVASSLVLLVSLGAISFWMCSNGSLQCRICI

SEQ ID NO: 6279 - protein, 566 aa, Artificial Sequence
  hemagglutinin__InfluenzaA__ADU59558
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6280 - protein, 566 aa, Artificial Sequence; identical to SEQ ID NO: 2669
  hemagglutinin__InfluenzaA__ADU59579

SEQ ID NO: 6281 - protein, 566 aa, Artificial Sequence; identical to SEQ ID NO: 2669
  hemagglutinin__InfluenzaA__ADU59590

SEQ ID NO: 6282 - protein, 566 aa, Artificial Sequence; identical to SEQ ID NO: 2669
  hemagglutinin__InfluenzaA__ADU59601

SEQ ID NO: 6283 - protein, 566 aa, Artificial Sequence; identical to SEQ ID NO: 2669
  hemagglutinin__InfluenzaA__ADU59612

SEQ ID NO: 6284 - protein, 566 aa, Artificial Sequence; identical to SEQ ID NO: 2669
  hemagglutinin__InfluenzaA__ADU59768

SEQ ID NO: 6285 - protein, 566 aa, Artificial Sequence; identical to SEQ ID NO: 2669
  hemagglutinin__InfluenzaA__ADU59769

SEQ ID NO: 6286 - protein, 566 aa, Artificial Sequence; identical to SEQ ID NO: 2669
  hemagglutinin__InfluenzaA__ADU59771

SEQ ID NO: 6287 - protein, 566 aa, Artificial Sequence; identical to SEQ ID NO: 2669
  hemagglutinin__InfluenzaA__ADU59772

SEQ ID NO: 6288 - protein, 566 aa, Artificial Sequence; identical to SEQ ID NO: 2669
  hemagglutinin__InfluenzaA__ADU59774

SEQ ID NO: 6289 - protein, 566 aa, Artificial Sequence; identical to SEQ ID NO: 2669
  hemagglutinin__InfluenzaA__ADU59906

SEQ ID NO: 6290 - protein, 566 aa, Artificial Sequence; identical to SEQ ID NO: 2669
  hemagglutinin__InfluenzaA__ADU59916

SEQ ID NO: 6291 - protein, 566 aa, Artificial Sequence; identical to SEQ ID NO: 2669
  hemagglutinin__InfluenzaA__ADU76756

SEQ ID NO: 6292 - protein, 566 aa, Artificial Sequence; identical to SEQ ID NO: 2669
  hemagglutinin__InfluenzaA__ADU76757

SEQ ID NO: 6293 - protein, 566 aa, Artificial Sequence; identical to SEQ ID NO: 2669
  hemagglutinin__InfluenzaA__ADU76758

SEQ ID NO: 6294 - protein, 566 aa, Artificial Sequence; identical to SEQ ID NO: 2669
  hemagglutinin__InfluenzaA__ADU76759

SEQ ID NO: 6295 - protein, 566 aa, Artificial Sequence; identical to SEQ ID NO: 3029
  hemagglutinin__InfluenzaA__ADU76761

SEQ ID NO: 6296 - protein, 566 aa, Artificial Sequence; identical to SEQ ID NO: 2669
  hemagglutinin__InfluenzaA__ADU76762

SEQ ID NO: 6297 - protein, 566 aa, Artificial Sequence
  hemagglutinin__InfluenzaA__ADU76764
MKAILVVLLYTFATANADTLCIGYHANNSTDTVDTVLEKNVTVTHSVNLLEDKHNGKLCKLRGVAPLHLGKCNIAGWILGNPECESLSTASSWSYIVEASSSNNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFIAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6298 - protein, 566 aa, Artificial Sequence
  hemagglutinin__InfluenzaA__ADU76765
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSSVASSLVLVVSLGAISFWMCSNGSLQCRICI

SEQ ID NO: 6299 - protein, 566 aa, Artificial Sequence; identical to SEQ ID NO: 4266
  hemagglutinin__InfluenzaA__ADU76766

SEQ ID NO: 6300 - protein, 566 aa, Artificial Sequence
  hemagglutinin__InfluenzaA__ADU76767
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6301 - protein, 566 aa, Artificial Sequence
  hemagglutinin__InfluenzaA__ADU76768
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 6302 - protein, 566 aa, Artificial Sequence; identical to SEQ ID NO: 2669
  hemagglutinin__InfluenzaA__ADU76769

SEQ ID NO: 6303 - protein, 566 aa, Artificial Sequence; identical to SEQ ID NO: 2669
  hemagglutinin__InfluenzaA__ADU76770

SEQ ID NO: 6304 - protein, 566 aa, Artificial Sequence; identical to SEQ ID NO: 2669
  hemagglutinin__InfluenzaA__ADU76771

SEQ ID NO: 6305 - protein, 566 aa, Artificial Sequence; identical to SEQ ID NO: 3414
  hemagglutinin__InfluenzaA__ADU76772

SEQ ID NO: 6306 - protein, 566 aa, Artificial Sequence; identical to SEQ ID NO: 2669
  hemagglutinin__InfluenzaA__ADU76774

SEQ ID NO: 6307 - protein, 566 aa, Artificial Sequence; identical to SEQ ID NO: 2669
  hemagglutinin__InfluenzaA__ADU76775

SEQ ID NO: 6308 - protein, 566 aa, Artificial Sequence; identical to SEQ ID NO: 2669
  hemagglutinin__InfluenzaA__ADU76776

SEQ ID NO: 6309 - protein, 566 aa, Artificial Sequence; identical to SEQ ID NO: 2669
  hemagglutinin__InfluenzaA__ADU76777

SEQ ID NO: 6310 - protein, 566 aa, Artificial Sequence; identical to SEQ ID NO: 2669
  hemagglutinin__InfluenzaA__ADU76778

SEQ ID NO: 6311 - protein, 566 aa, Artificial Sequence; identical to SEQ ID NO: 5527
  hemagglutinin__InfluenzaA__ADU76779

SEQ ID NO: 6312 - protein, 566 aa, Artificial Sequence; identical to SEQ ID NO: 2669
  hemagglutinin__InfluenzaA__ADU76780

SEQ ID NO: 6313 - protein, 566 aa, Artificial Sequence; identical to SEQ ID NO: 4266
  hemagglutinin__InfluenzaA__ADU76781

SEQ ID NO: 6314 - protein, 566 aa, Artificial Sequence; identical to SEQ ID NO: 3029
  hemagglutinin__InfluenzaA__ADU76782

SEQ ID NO: 6315 - protein, 566 aa, Artificial Sequence
  hemagglutinin__InfluenzaA__ADU76784
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSNNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6316 - protein, 566 aa, Artificial Sequence; identical to SEQ ID NO: 2669
  hemagglutinin__InfluenzaA__ADU76785

SEQ ID NO: 6317 - protein, 566 aa, Artificial Sequence; identical to SEQ ID NO: 2669
  hemagglutinin__InfluenzaA__ADU76786

SEQ ID NO: 6318 - protein, 566 aa, Artificial Sequence
  hemagglutinin__InfluenzaA__ADU76787
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFHNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6319 - protein, 566 aa, Artificial Sequence; identical to SEQ ID NO: 6300
  hemagglutinin__InfluenzaA__ADU76788

SEQ ID NO: 6320 - protein, 566 aa, Artificial Sequence; identical to SEQ ID NO: 6300
  hemagglutinin__InfluenzaA__ADU76789

SEQ ID NO: 6321 - protein, 566 aa, Artificial Sequence; identical to SEQ ID NO: 2669
  hemagglutinin__InfluenzaA__ADU76790

SEQ ID NO: 6322 - protein, 566 aa, Artificial Sequence; identical to SEQ ID NO: 2669
  hemagglutinin__InfluenzaA__ADU76791

SEQ ID NO: 6323 - protein, 566 aa, Artificial Sequence; identical to SEQ ID NO: 6300
  hemagglutinin__InfluenzaA__ADU76792

SEQ ID NO: 6324 - protein, 566 aa, Artificial Sequence
  hemagglutinin__InfluenzaA__ADU76793
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGTKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6325 - protein, 566 aa, Artificial Sequence
  hemagglutinin__InfluenzaA__ADU85911
MKAIIVVLLYTFATADADTLCIGYHANNSTDTVDTVLEKNVTVTHSVNLLENKHNGKLCKLGGIAPLHLGKCDIAGWLLGNPECESLFTASSWSYIVETPNSDNGTCYPGDFINYEELREHLSSVSSFERFEIFPKANSWPNHDTNKGVTAACPYAGANSFYRNLIWLVKKGNSYPKLSKSYINNKKKEVLVIWGIHHPPTSTDQQTLYQNADAYVFVGSSKYSKRFKPEIAARPKVRDQAGRMDYYWTLIEPGDTITFEATGNLVVPRYAFAMKRGSGSGIIVSDAPVHDCNTTCQTPKGAINTSLPFQNIHPVTIGECPKYVKSTKLRMATGLRNIPSIQSRGLFGAIAGFLEGGWTGMIDGWYGYHHQNEQGSGYAADQKSTQNAIDGITNKVNSIIEKMNTQFTAVGKEFSQLEKRIESLNNKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESARIYQILAIYSTVASSLVLLVSLGAISFWMCSNGSLQCRICI

SEQ ID NO: 6326 - protein, 566 aa, Artificial Sequence; identical to SEQ ID NO: 3833
  hemagglutinin__InfluenzaA__ADV17283

SEQ ID NO: 6327 - protein, 566 aa, Artificial Sequence; identical to SEQ ID NO: 3833
  hemagglutinin__InfluenzaA__ADV17293

SEQ ID NO: 6328 - protein, 566 aa, Artificial Sequence
  hemagglutinin__InfluenzaA__ADV17303
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLAKGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6329 - protein, 566 aa, Artificial Sequence; identical to SEQ ID NO: 3833
  hemagglutinin__InfluenzaA__ADV17313

SEQ ID NO: 6330 - protein, 566 aa, Artificial Sequence
  hemagglutinin__InfluenzaA__ADV17323
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQGLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNYVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6331 - protein, 566 aa, Artificial Sequence
  hemagglutinin__InfluenzaA__ADV17333
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQNLYQNADAYVFVGTSRYSKKFKPEIAIRPKVRDQEGRMNYYWTLVEPGDKITFEATGNLVVLRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYYDSNVKNLYEKVRSQLKNNAKEIGNGCFEFYHKCDNTCMESVKNGTYDYPKYSEEAKLNREEIDGVKLESTRIYQILVIYSTVASSLVLVVSLGAISFWMCSNGSLQCRICI

SEQ ID NO: 6332 - protein, 566 aa, Artificial Sequence; identical to SEQ ID NO: 2669
  hemagglutinin__InfluenzaA__ADV19019

SEQ ID NO: 6333 - protein, 566 aa, Artificial Sequence; identical to SEQ ID NO: 3154
  hemagglutinin__InfluenzaA__ADV41677

SEQ ID NO: 6334 - protein, 566 aa, Artificial Sequence
  hemagglutinin__InfluenzaA__ADV58939
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNETYDYPKYSEEAKLNREEIDGVKLESTRIYQILAIYSTVASSLVLVVSLGAISFWMCSNGSLQCRICI

SEQ ID NO: 6335 - protein, 565 aa, Artificial Sequence
  hemagglutinin__InfluenzaA__ADV69074
MKVKLLVLLCTFTATYADTICIGYHANNSTDTVDTVLEKNVTVTHSVNLLEDSHNGKLCLLKGIAPLQLGNCNVAGWILGNPECELLISKESWSYIVETPDPENGTCYPGYFTDYEELREQLSSVSSFKRFEIFPKESSWPNHTVTGVSASCSHNGKSSFYRNLLWLTVKNGLYPNLSKSYTNDKEKEVLVLWGVHHPPSIGDQRTLYHTENAYVSVVSSHYSRRFTPEIVKRPKVRDQEGRINYYWTLLEPGDTIICEANGNLIAPRYAFALSRGLGSGIITSNAPMGECNAKCQTPQGAINSSLPFQNVHPVTIGECPKYVKSAKLRMVTGLRNTPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMEVYQILAIYSTVASSLVFLVALGAICFWMCSNGSLQCKICI

SEQ ID NO: 6336 - protein, 565 aa, Artificial Sequence
  hemagglutinin__InfluenzaA__ADV69075
MKVKLLVLLCTFTATYADTICIGYHANNSTDTVDTVLEKNVTVTHSVNLLEDSHNGKLCLLKGIAPLQLGNCNVAGWILGNPECELLISKESWSYIVETPDPENGTCYPGYVTDYEELREQLSSVSSFKRFEIFPKESSWPNHTVTGVSASCSHNGKSSFYRNLLWLTVKNGLYPNLSKSYTNDKEKEVLVLWGVHHPPSIGDQRTLYHTENAYVSVVSSHYSRRFTPEIVKRPKVRDQEGRINYYWTLLEPGDTIICEANGNLIAPRYAFALSRGFGSGIITSNAPMGECNAKCQTPQGAINSSLPFQNVHPVTIGECPKYVKSAKLRMVTGLRNTPSIQSRGLFGAIAGFIEGGWTGMVDGWYGYHHPNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNKVKEIGNGCFEFYHKCNDECMESVKNGTYDYPKYSEESKLNREKIDGVKLESMEVYQILAIYSTVASSLVFLVALGAICFWMCSNGSLQCKICI

SEQ ID NO: 6337 - protein, 565 aa, Artificial Sequence
  hemagglutinin__InfluenzaA__ADV69077
MKVKLLVLLCTFTATYADTICIGYHANNSTDTVDTVLEKNVTVTHSVNLLEDSHNGKLCLLKGIAPLQLGNCNVAGWILGNPECELLISKESWSYIVETPDPENGTCYPGYFTDYEELREQLSSVSSFKRFEIFPKESSWPNHTVTGVSASCSHNGKSSFYRNLLWLTVKNGLYPNLSKSYTNDKEKEVLVLWGVHHPPSIGDQRTLYHTENAYVSVVSSHYSRRFTPEIVKRPKVRDQEGRINYYWTLLEPGDTIIFEANGNLIAPRYAFALSRGFGSGIITSNAPMGECNAKCQTPQGAINSSLPFQNVHPVTIGECPKYVKSAKLRMVTGLRNTPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMEVYQILAIYSTVASSLVFLVALGAICFWMCSNGSLQCKICI

SEQ ID NO: 6338 - protein, 565 aa, Artificial Sequence
  hemagglutinin__InfluenzaA__ADV69078
MKVKLLILLCTFTATYADTICIGYHANNSTDTVDTVLEKNVTVTHSVNLLEDSHNGKLCLLKGIAPLQLGNCSVAGWILGNPECESLISKKSWSYIVETPNPENGACYPGEFADYEELREQLSSVSSFERFEIFPKESSWPNHTAAGVSASCSHNGEKSFYRNLIWLTKKNGLYPNLSKSYENDKEKEVLILWGVHHPPNIENQRTLYRTENAYVSVVSSHYSGRFTPEITKRPKVRNQEGRINYYWTLLEPGDTIIFEANGNLIAPWYAFTLSRGLGSGIITSNAPMDECDAKCQTPQGAINSSLPFQNVHPVTIGECPKYVRSSKLRMVTGLRNIPSIQSRGLFGAIAGFIEGGWTGMVDGWYGYHHQNEQGSGYAADQESTQNAINGITNKVNSVIEKMNTQFTAVGKEFNKLERRMENLNKKVDDGFLDIWTYNAELLVLLENERTLDFHDSNVKSLYEKVKSQLKNNAKEIGNGCFEFYHKCNNECMESVKNGTYDYPKYSEESKLNREKIDGVKLDSMGVYRILAIYSTVASSLVLLVSLGAISFWMCSNGSLQCRICI

SEQ ID NO: 6339 - protein, 565 aa, Artificial Sequence
  hemagglutinin__InfluenzaA__ADV69079
MKVKLLILLCTFTATYADTICIGYHANNSTDTVDTVLEKNVTVTHSVNLLEDSHNGKLCLLKGIAPLQLGNCSVAGWILGNPECELLISKKSWSYIVKTPNPENGSCYPGYFADYEELREQLSSVSSFERFEMFPKESSWPNHNVNGVSASCSHNGKRSFYRNLLWLTGKNGLYPNLTKSYENNNEKEVLILWGVHHPSNIGDQRTLYHTENAYVSVMSSHYSRRFTPEINKRPKVRDQEGRINYYWTLLEPGDTIIFEANGNLIAPWYAFALSRGFGSGIITSSAPMDECDAKCQTPRGAINSSLPFQNVHPVTIGECPKYVRSAKLRMVTGLRNIPSIQSRGLFGAIAGFIEGGWTGMVDGWYGYHHQNEQGSGYAADQESTQNAINGITNKVNSVIEKMNTQFTAVGKEFNKLERRMENLNKKVDDGFLDIWTYNAELLVLLENERTLDFHDSNVKSLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 6340 - protein, 565 aa, Artificial Sequence
  hemagglutinin__InfluenzaA__ADV69080
MKVKLLILLCTFTATYADTICIGYHANNSTDTVDTVLEKNVTVTHSVNLLEDSHNGKLCLLKGIAPLQLGNCSVAGWILGNPECESLISKKSWSYIVETPNPENGACYPGEFADYEELREQLSSVSSFERFEIFPKESSWPNHTAAGVSASCSHNGERSFYRNLIWLTMKNGLYPNLRKSYENDKEKEVLILWGVHHPPNIENQRTLYHTENAYVSVVSSHYSGRFTPEITKRPKVRDQEGRINYYWTLLEPGDTIIFEANGNLIAPWYAFTLSRGLGSGIITSNAPMDACDAKCQTPQGAINSSLPFQNVHPVTIGECPKYVRSAKLRMVTGLRNIPSIQSRGLFGAIAGFIEGGWTGMVDGWYGYHHQNEQGSGYAADQESTQNAINGITNKVNSVIEKMNTQFTAVGKEFNKLERRIENLNKKVDDGFIDIWTYNAELLVLLENERTLDFHDSNVKSLYEKVKSQLKNNAKEIGNGCFEFYHKCNNECMESVKNGTYDYPKYSEESKLNREKIDGVKLDSMGVYRILAIYSTVASSLVLLVSLGAISFWMCSNGSLQCRICI

SEQ ID NO: 6341 - protein, 565 aa, Artificial Sequence
  hemagglutinin__InfluenzaA__ADV69081
MKVKLLVLLCTFTATYADTICIGYHANNSTDTVDTVLEKNVTVTHSVNLLEDSHNGKLCLLKGIAPLQLGNCNVAGWILGNPECELLISKESWSYIVETPNPENGTCYPGYFTDYEELREQLSSVSSFKRFEIFPKESSWPNHTVTGVSASCSHNGESSFYRNLLWLTVKNGLYPKLSKSYTNDKEKEVLVLWGVHHPPNIRDQRTLYHTENAYVSVVSSHYSRRFTPEIVKRPKVRDQEGRINYYWTLLEPGDTIIFEANGNLIAPRYAFALSRGFGSGIITSNAPMGECNAKCQTPQGAIISSLPFQNVHPVTIGECPKYVKSAKLRMVTGLRNTPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMEVYQILAIYSTVASSLVFLVALGAICFWMCSNGSLQCKICI

SEQ ID NO: 6342 - protein, 565 aa, Artificial Sequence
  hemagglutinin__InfluenzaA__ADV69083
MKVKLMVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHNVTGVSSSCSHNGKSSFYRNLLWLTVKNGLYPNLSKSYTNKKEKEVLVLWGVHHPSNIGDQRALYHTENAYVSVVSSHYSRRFTPEIAKRPKVRNQEGRINYYWTLLEPGDTIILEANGNLIAPRYAFELSKGLGSGIITSNAPMGECNAKCQTPQGAINSSLPFQNVHPVTIGECPKYVKSAKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6343 - protein, 565 aa, Artificial Sequence
  hemagglutinin__InfluenzaA__ADV69084
MKVKLMVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHNVTGVSSSCSHNGKSSFYRNLLWLTVKNGLYPNLSKSYTNKKEKEVLILWGVHHPSNIRDQRALYYTENAYVSVVSSHYSRRFTPEIAKRPKVRNQEGRINYYWTLLEPGDTIIFEANGNLIAPRYAFELSKGFGSGIITSDAPMGECNAKCQTPQGAINSSLPFQNVHPVTIGECPKYVRSAKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKKIDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6344 - protein, 565 aa, Artificial Sequence
  hemagglutinin__InfluenzaA__ADV69085
MKVKLMVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHTVTGVSSSCSHNGKSSFYRNLLWLTMKNGLYPNLSKSYTNKKEKEVLVLWGVHHPSNIGDQRALYHTENAYVSVVSSHYSRRFTPEIAKRPKVRNQEGRINYYWTLLEPGDTIIFEANGNLIAPRYAFELSKGFGSGIITSNAPMGECNAKCQTPQGAINSSLPFQNVHPVTIGECPKYVRSSKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKKIDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6345 - protein, 565 aa, Artificial Sequence
  hemagglutinin__InfluenzaA__ADV69086
MKVKLLVLLCTFTATYADTICIGYHANNSTDTVDTVLEKNVTVTHSVNLLEDSHNGKLCLLKGIAPLQLGNCNVAGWILGNPECELLISKESWSYIVETPNPENGTCYPGYFTDYEELREQLSSVSSFKRFEIFPKESSWPKHTVTGVSASCSHNGKSSFYRNLLWLTGKNGLYPNLSKSYTNDKEKEVLVLWGVHHPSNIGDQRALYHKENAYVSVVSSHYSRRFTPEIVKRPKVRDQEGRINYYWTLLEPGDTIIFEANGNLIAPRYAFALSRGFGSGIITSNAPMDECNTKCQTPQGAINSSLPFQNVHPVTIGECPKYVKSAKLRMVTGLRNTPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMEVYQILAIYSTVASSLVFLVSLGAICFWMCSNGSLQCRICI

SEQ ID NO: 6346 - protein, 565 aa, Artificial Sequence
  hemagglutinin__InfluenzaA__ADV69087
MKVKLMVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHTVNGVSSSCSHNGESSFYRNLLWLTVKDGLYPNLSKSYTNKKEKEVLVLWGVHHPSNIGDQRALYHTENAYVSVVSSHYSRRFTPEIAKRPKVRNQEGRINYYWTLLEPGDTIIFEANGNLIAPRYAFELSKGFGSGIITSNAPMGECNAKCQTPQGAINSSLPFQNVHPVTIGECPKYVRSTKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKKIDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6347 - protein, 565 aa, Artificial Sequence
  hemagglutinin__InfluenzaA__ADV69088
MKVKLLILLCTFTATYADTICIGYHANNSTDTVDTVLEKNVTVTHSVNLLEDSHNGKLCLLKGIAPLQLGNCSVTGWILGNPECELLISKKSWSYIVETPNPENGACYPGYFADYEELREQLSSVSSFERFEIFPKESSWPNHNVNGVSASCSHNGKSSFYRNLLWLTGKNGLYPSLTKSYANDKEKEVLILWGVHHPSNIGDQRTLYHTENAYVSVMSSHYSRRFTPEISKRPKVRDQEGRINYYWTLLEPGDTIIFEANGNLIAPWYAFALSRGFGSGIITSSAPMDACDAKCQTPQGAINSSLPFQNVHPVTIGECPKYVRSTKLRMVTGLRNIPSIQSRGLFGAIAGFIEGGWTGMVDGWYGYHHQNEQGSGYAADQESTQNALHGITNKVNSVIEKMNTQFTAVGKEFNKLERRMENLNKKVDDGFLDIWTYNAELLVLLENERTLDFHDSNVKSLYEKVKIQLKNNAKEIGNGCFEFYHKCNNECMESVRNGTYDYPKYSEESKLNREKIDGVKLDSMGVYQILAIYSTVASSLVLLVSLGAISFWMCSNGSLQCRICI

SEQ ID NO: 6348 - protein, 565 aa, Artificial Sequence
  hemagglutinin__InfluenzaA__ADV69089
MKVKLLILLCTFTATYADTICIGYHANNSTDTVDTVLEKNVTVTHSVNLLEDSHNGKLCLLKGIAPLQLGNCSVAGWILGNPECELLISKKSWSYIVETPNPENGACYPGYFADYEELREQLSSVSSFERFEIFPKESSWPNHNVNGVSASCSHNGKSSFYRNLLWLTGKNGLYPNLTKSYANNKEKEVLILWGVHHPSNIGDQRTLYHTENAYVSVMSSHYSRRFTPEITKRPKIRDQEGRINYYWTLLEPGDTIIYEANGNLIAPWYAFALSRGFGSGIITSSAPMDECDAKCQTPQGAINSSLPFQNVHPVTIGECPKYVRSAKLRMVTGLRNIPSIQSRGLFGAIAGFIEGGWTGMVNGWYGYRLHNDQGSGYAADQKSTQNALNGITNKVNSVIEKMNTQFTAVGKEFNKLERRMENLNKKVDDGFLDIWTYNAEMLVLLENERTLDFHDSNVKSLYERVKIQLKNNAKEIGNGCFEFYHKCNNECMESVRNGTYDYPKYSEESKLNREKIDGVKLDSMGVYQILAIYSTVASSLVLLVSLGAISFWMCSNGSLQCRICI

SEQ ID NO: 6349 - protein, 565 aa, Artificial Sequence
  hemagglutinin__InfluenzaA__ADV69090
MKVKLLVLLCTFTATYADTICIGYHANNSTDTVDTVLEKNVTVTHSVNLLEDSHNGKLCLLKGIAPLQLGNCSVAGWILGNPECESLISKESWSYIVETPNPENGTCYPGYFADYEELREQLSSVSSFERFEIFPKESSWPNHTVTGVSASCSHNGKSSFYRNLLWLTRKNGLYPNLSKSYANNKEKEVLVLWGVHHPPNLGDQRALYHTENAYVSVVSSHYSRRFTPEIAKRPKVRDQEGRINYYWTLLEPGDTIIFEANGNLIAPRFAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6350 - protein, 565 aa, Artificial Sequence
  hemagglutinin__InfluenzaA__ADV69091
MKVKLLVLLCTFTATYADTICIGYHANNSTDTVDTVLEKNVTVTHSVNLLEDSHNGKLCLLKGIAPLQLGNCNVAGWILGNPECELLISKESWSYIVETPNPENGTCYPGYFTDYEELREQLSSVSSFKRFEIFPKESSWPNHTVTGVSASCSHNGKSSFYRNLLWLTRKNGLYPNLSKSYTNDKEKEVLVLWGVHHPSNIGDQRALYHKENAYVSVVSSHYSRRFTPEIVKRPKVRDQEGRINYYWTLLEPGDTIIFEANGNLIAPRYAFALSRGFGSGIITSNAPMDECNTKCQTPQGAINSSLPFQNVHPVTIGECPKYVKSAKLRMVTGLRNTPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNDECMESVKNGTYDYPKYSEESKLNREKIDGVKLESMEVYQILAIYSTVASSLVFLVSLGAICFWMCSNGSLQCRICI

SEQ ID NO: 6351 - protein, 565 aa, Artificial Sequence
  hemagglutinin__InfluenzaA__ADV69092
MKVKLLVLLCTFTATYADTICIGYHANNSTDTVDTVLEKNVTVTHSVNLLEDSHNGKLCLLKGIAPLQLGNCNVAGWILGNPECELLISKESWSYIVETPNPENGTCYPGYFTDYEELREQLSSVSSFKRFEIFPKESSWPNHTVTGVSASCSHNGKSSFYRNLLWLTGKNGLYPNLSKSYTNDKEKEVLVLWGVHHPSNIGDQRALYHKENAYVSVVSSHYSRRFTPEIVKRPKVRDQEGRINYYWTLLEPGDTIIFEANGNLIAPRYAFALSRGFGSGIITSNAPMDECNTKCQTPQGAINSSLPFQNVHPVTIGECPKYVKSAKLRMVTGLRNTLSIQSKGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMEVYQILAIYSTVASSLVFLVSLGAICFWMCSNGSLQCRICI

SEQ ID NO: 6352 - protein, 565 aa, Artificial Sequence
  hemagglutinin__InfluenzaA__ADV69093
MKVKLMVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYVTDYEELREQLSSVSSFKRFEIFPKESSWPNHTVTGVSSSCSHNGKSSFYRNLLWLTVKNGLYPNLSKSYTNKKEKEVLVLWGVHHPSNIGDQRALYHTENAYVSVVSSHYSRRFTPEIAKRPKVRNQEGRINYYWTLLEPGDTIIFEANGNLIAPRYAFELSKGFGSGIITSNAPMGECNAKCQTPQGAINSSLPFQNVHPVTIGECPKYVKSAKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKRVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6353 - protein, 565 aa, Artificial Sequence
  hemagglutinin__InfluenzaA__ADV69094
MKVKLMVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHTVTGVSSSCSHNGKSSFYRNLLWLTVKNGLYPNLSKSYTNKKEKEVLVLWGVHHPSNIGDQRALYHTENAYVSVVSSHYSRRFTPEIAKRPKVRNQEGRINYYWTLLEPGDTIIFEANGNLIAPRYAFELSKGFGSGIITSNAPMGECNAKCQTPQGAINSSLPFQNVHPVTIGECPKYVKSAKLRMVTGLRNTPSIQSRGLFGAIAGFIEGGWTGMVHGWYGYHHQNEQGSGYAAEQQSTQYAINGITNKVNSVIEKMNTQFTAVGKEFNKLERRMENLNKRVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6354 - protein, 565 aa, Artificial Sequence
  hemagglutinin__InfluenzaA__ADV69095
MKVKLMVLLCTFTATYADTICVGYHANNSTDTVDTVLEKNVTVTHSVNLLEDSHNGKLCLLKGIAPLQLGSCSVAGWILGNPECELLISKESWSYIVEPPNPENGTCYPGYFTDYEELREQLSSVSSFKRFEIFPKESSWPNHTVNGVSSSCSHNGESSFYRNLLWLTVKDGLYPNLSKSYTNKKEKEVLVLWGVHHPSNIGDQRALYHTENAYVSVVSSHYSRRFTPEIAKRPKVRNQEGRINYYWTLLEPGDTIIFEANGNLIAPRYAFELSKGFGSGIITSNAPMGECNAKCQTPQGAINSSLPFQNVHPVTIGECPKYVRSTKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKKIDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6355 - protein, 565 aa, Artificial Sequence
  hemagglutinin__InfluenzaA__ADV69096
MKVKLMVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYVTDYEELREQLSSVSSFKRFEIFPKESSWPNHTVTGVSSSCSHNGKSSFYRNLLWLTVKNGLYPNLSKSYTNKKEKEVLVLWGVHHPSNIGDQRALYHTENAYVSVVSSHYSRRFTPEIAKRPKVRNQEGRINYYWTLLEPGDTIIFEANGNLIAPRYAFELSKGFGSGIITSNAPMGECNAKCQTPKGAINSSLPFQNVHPVTIGECPKYVKSAKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKKVDDGFLDIWTYNAELLVLLENERTLDFHESNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6356 - protein, 565 aa, Artificial Sequence
  hemagglutinin__InfluenzaA__ADV69097
MKVKLLILLCTFTATYADTICIGYHANNSTDTVDTVLEKNVTVTHSVNLLEDSHNGKLCLLKGIAPLQLGNCSVAGWILGNPECELLISKKSWSYIVETPNPGNGACYPGYFADYEELREQLSSVSSFERFEIFPKESSWSNHNVNGVSASCSHNGKSSFYRNLLWLTGKNGLYPTLTKSYANDKEKEVLILWGVHHPSNIGDQRTLYHTENAYVSVMSSHYSRRFTPEISKRPKVRDQEGRINYYWTLLEPGDTIIFEANGNLIAPWYAFALSRGFGSGIITSNAPMDECDAKCQTPQGAINSSLPFQNIHPVTIGECPKYVRSAKLRMVTGLRNTPSIQSRGLFGAIAGFIEGGWTGMVDGWYGYHHQNEQGSGYAADQESTQNAINEITNKENSVIEKMNTQFTSVGKEFNKLERRMENLNKKVDDGFLDIWTYNAELLVLLENERTLDFHDSNVKSLYEKVKIQLKNNAKEIGNGCFEFYHKCNNECMESVRNGTYDYPKYSEESKLNREKIDGVKLDSMGVYQILAIYSTVASSLVLLVSLGAISFWMCSNGSLQCRICI

SEQ ID NO: 6357 - protein, 565 aa, Artificial Sequence
  hemagglutinin__InfluenzaA__ADV69098
MKVKLIVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHTVTGVSSSCSHNGNSSFYRNLLWLTVKNGLYPNLSKSYTNKKEKEVLVLWGVHHPSNIEDQRALYHTENAYVSVVSSHYSRRFNPEIAKRPKVRNQEGRINYYWTLLEPGDTIIFEANGNLIAPRYAFELSKGFGSGIITSNAPMGECNAKCQTPQGAINSNLPFQNVHPVTIGECPKYVRSAKLRMVTGLRNTPSIQSRGLFGAIAGFIEGGWTGMVDGWYGYHHHNEQGSGYAANQKSTPNAINGITNKVNSVIEKMNTQFTAVGKEFNKLERRMENLNKKVDDGFLDIWTYNAELLVLLENERTLDFHDSNVKNLYEKVRSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6358 - protein, 565 aa, Artificial Sequence
  hemagglutinin__InfluenzaA__ADV69099
MKVKLIVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHTVTGVSSSCSHNGNSSFYRNLLWLTVKNGLYPNLSKSYTNKKEKEVLVLWGVHHPSNIEDQRALYHTENAYVSVVSSHYSRRFNPEIAKRPKVRNQEGRINYYWTLLEPGDTIIFEANGNLIAPRYAFELSKGFGSGIITSNAPMGECNAKCQTPQGAINSNLPFQNVHPVTIGECPKYVRSAKLRMVTGLRNTPSIQSRGLFGAIAGFIEGGWTGMVNGWYGYHHHNEQGSGYAANQQSPPNAINGITNKVNSVIEKMNTQFTAVGKEFNKLERRMENLNKKVDDGFLDIWTYNAELLVLLENERTLDFHDSNVKNLYEKVRSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6359 - protein, 565 aa, Artificial Sequence
  hemagglutinin__InfluenzaA__ADV69100
MKVKLLILLCTFTATYADTICIGYHANNSTDTVDTVLEKNVTVTHSVNLLEDSHNGKLCLLKGIAPLQLGNCSVAGWILGNPECESLISKKSWSYIVETPKPENGTCYPGEFADYEELREQLSSVSSFERFEIFPKESSWPNHTAAGVSASCSHNGERSFYKNLIWLTVKNGLYPNLSKSYKNDKEKEVLILWGVHHPPNIENQRTLYHTENTYVSVVSSHYSGRFTPEITKRPKVRDQEGRINYYWTLLEPGDTIIFEANGNLIAPWYAFTLSRGLGSGIVTSNAPMDKCDAKCQTPHGAINSSLPFQNVHPVTIGECPKYVRSAKLRMVTGLRNIPSIQSRGLFGAIAGFIEGGWTGMVDGWYGYHHQNEQGSGYAADQESTQNAINGITNKVNSVIEKMNTQFTAVGKEFNKLERRMENLNKKVDDGFLDIWTYNAELLVLLENERTLDFHDSNVKSLYEKVKSQLKNNAKEIGNGCFEFYHKCNNECMESVKNGTYDYPKYSEESKLNREKIDGVKLDSMGVYRILAIYSTVASSLVLLVSLGAISFWMCSNGSLQCRICI

SEQ ID NO: 6360 - protein, 565 aa, Artificial Sequence
  hemagglutinin__InfluenzaA__ADV69101
MKVKLLILFCTFTATYADTICIGYHANNSTDTVDTVLEKNVTVTHSVNLLEDSHNGKLCLLKGIAPLQLGNCSVAGWILGNPECESLISKKSWSYIVETPNPENGACYPGEFADYEELREQLSSVSSFERFEIFPKESSWPNHTATGVSASCSHNGERSFYRNLIWLTVKNGLYPNLSKSYENDKEKEVLILWGVHHPPNIENQRTLYHTENAYVSVVSSHYSGRFTPEITKRPKVRDQEGRINYYWTLLEPGDTIIFEANGNLIAPWYAFTLSRGLGSGIITSNAPMDECDSKCQTPQGAINSSLPFQNVHPVTIGECPKYVRSAKLRMVTGLRNIPSIQSRGLFGAIAGFIEGGWTGMVDGWYGYHHQNEQGSGYAADQESTQNAINGITNKVNSVIEKMNPQFTAVGKEFNKLERRMENLNKKVDDGFLDIWTYNAELLVLLENERTLDFHDSNVKSLYEKVKSQLKNNAKEIGNGCFEFYHKCNNECMESVKNGTYDYPKYSEESKLNREKIDGVKLDSMGVYRILAIYSTVASSLVLLVSLGAISFWMCSNGSLQCRICI

SEQ ID NO: 6361 - protein, 565 aa, Artificial Sequence
  hemagglutinin__InfluenzaA__ADV69102
MKVKLLILFCTFTATYADTICIGYHANNSTDTVDTVLEKNVTVTHSVNLLEDSHNGKLCLLKGIAPLQLGNCSVAGWILGNPECESLISKKSWSYIVETPNPENGACYPGEFADYEELREQLSSVSSFERFEIFPKESSWPNHTATGVSASCSHNGERSFYRNLIWLTVKNGLYPNLSKSYENDKEKEVLILWGVHHPPNIENQRTLYHTENAYVSVVSSHYSGRFTPEITKRPKVRDQEGRINYYWTLLEPGDTIIFEANGNLIAPWYAFTLSTGLGSGIITSNAPMDECDSKCQTPQGAINSSLPFQNVHPVTIGECPKYVRSAKLRMVTGLRNIPSIQSRGLFGAIAGFIEGGWTGMVDGWYGYHHQNEQGSGYAADQESTQNAINGITNKVNSVIEKMNTQFTAVGKEFNKLERRMENLNKKVDDGFLDIWTYNAELLVLLENERTLDFHDSNVKSLYEKVKSQLKNNAKEIGNGCFEFYHKCNNECMESVKNGTYDYPKYSEESKLNREKIDGVKLDSMGVYRILAIYSTVASSLVLLVSLGAISFWMCSNGSLQCRICI

SEQ ID NO: 6362 - protein, 565 aa, Artificial Sequence
  hemagglutinin__InfluenzaA__ADV69103
MKVKLMVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHNVTGVSSSCSHNGKSSFYRNLLWLTVKNGLYPNLSKSYTNKKEKEVLVLWGVHHPSNIGDQRALYHTENAYVSVVSSHYSRRFTPEIAKRPKVRNQEGRINYYWTLLEPGDTIIFEANGNLIAPRYAFELSKGFGSGIITSNAPIGECNAKCQTPQGAINSSLPFQNVNPVTIGECPKYVKSAKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6363 - protein, 565 aa, Artificial Sequence
  hemagglutinin__InfluenzaA__ADV69104
MKVKLLILFCTFTATYADTICIGYHANNSTDTVDTVLEKNVTVTHSVNLLEDSHNGKLCLLKGIAPLQLGNCSVAGWILGNPECESLISKKSWSYIVETPNPENGACYPGEFADYEELREQLSSVSSFERFEIFPKESSWPNHTATGVSASCSHNGERSFYRNLIWLTVKNGLYPNLSKSYENDKEKEVLILWGVHHPPNIENQRTLYHTENAYVSVVSSHYSGRFTPEITKRPKVRDQEGRINYYWTLLEPGDTIIFEANGNLIAPWYAFTLSRGLGSGIITSNAPMDECDSKCQTPQGAINSSLPFQNVHPVTIGECPKYVRSAKLRMVTGLRNIPSIQSRGLFGAIAGFIEGGWTGMVDGWYGYHHQNEQGSGYAADQESTQNAINGITNKVNSVIEKMNTQFTAVGKEFNKLERRMENLNKKVDDGFLDIWTYNAELLVLLENERTLDFHDSNVKSLYEKVKSQLKNNAKEIGNGCFEFYHKCNNECMESVKNGTYDYPKYSEESKLNREKIDGVKLDSMGVYRILAIYSTVASSLVLLVSLGAISFWMCSNGSLQCRICI

SEQ ID NO: 6364 - protein, 565 aa, Artificial Sequence
  hemagglutinin__InfluenzaA__ADV69105
MKVKLLILLCTFTATYADTICIGYHANNSTDTVDTVLEKNVTVTHSVNLLEDSHNGKLCLLKGIAPLQLGNCSVAGWILGNPECESLISKKSWSYIVETPNPENGACYPGEFADYEELREQLSSVSSFERFEIFPKESSWPNHTAAGVSASCSHNGERSFYRNLIWLTVKNGLYPNLSKSYKNDKEKEVLIIWGVHHPPNIENQRTLYHTENAYVSVVSSHYSGRFTPEITKRPKVRDQEGRINYYWTLLEPGDTIIFEANGNLIAPWYAFTLSRGLGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQESTQNAINGITNKVNSVIEKMNTQFTAVGKEFNKLERRMENLNKKVDDGFLDIWTYNAELLVLLENERTLDFHDSNVKSLYEKVKSQLKNNAKEIGNGCFEFYHKCNNECMESVKNGTYDYPKYSEESKLNREKIDGVKLDSMGVYRILAIYSTVASSLVLLVSLGAISFWMCSNGSLQCRICI

SEQ ID NO: 6365 - protein, 565 aa, Artificial Sequence
  hemagglutinin__InfluenzaA__ADV69106
MKVKLLILLCTFTATYADTICIGYHANNSTDTVDTVLEKNVTVTHSVNLLEDSHNGKLCLLKGIAPLQLGNCSVAGWILGNPECESLISKKSWSYIVETPNPGNGACYPGYFADYEELREQLSSVSSFERFEMFPKESSWPNHNVNGVSASCSHNGKSSFYRNLLWLTRKNGLYPNLTKSYANNNDKEVLILWGVHHPSNIGDQRTLYHTENAYVSVMSSHYSRRFTPEITKRPKVRDQEGRINYYWTLLEPGDTIIFEANGNLIAPWYAFALSRSFGSGIITSSAPMDECDAKCQTPQGAINSSLPFQNVHPVTIGECPKYVRSAKLKMVTGLRNIPSIQSRGLFGAIAGFIEGGWTGMVDGWYGYHHQNEQGSGYAADQESTQNAINGITNKVNSVIEKMNTQFTAVGKEFNKLEKRMENLNKKVDDGFLDIWTYNAELLVLLENERTLDFHDSNVKSLYEKVKIQLKNNAKEIGNGCFEFYHKCNNECMESVRNGTYDYPKYSEESKLNREKIDGVKLDSMGVYQILAIYSTVASSLVLLVSLGAISFWMCSNGSLQCRICI

SEQ ID NO: 6366 - protein, 565 aa, Artificial Sequence
  hemagglutinin__InfluenzaA__ADV69107
MKVKLLILLCTFTATYADTICIGYHANNSTDTVDTVLEKNVTVTHSVNLLEDSHNGKLCLLKGIAPLQLGNCSVAGWILGNPECESLISKESWSYIVETPNSDNGACYPGQFTDYEELREQLSSVSSFERFEIFPKESSWPNHTVTGVSASCSHNGERSFYRNLIWLTVKNGLYPNLSKSYENDKEKEVLILWGVHHPPNIGDQRTLYHTENAYISVVSSHYSGRFTPEITKRPKVRDQEGRINYYWTLLEPGDTIIFEANGNLIAPWYAFALSRGLGSGIITSNAPMDKCDAKCQTPQGAINSSLPFQNVHPVTIGECPKYVRSTKLRMVTGLRNIPSIQSRGLFGAIAGFIEGGWTGMVDGWYGYHHQNEQGSGYAADQESTQNAINGITNKVNSVIEKMNTQFTAVGKEFNKLERRMENLNKKVDDGFLDIWTYNAELLVLLENERTLDFHDSNVKSLYEKVKSQLKNNAKEIGNGCFEFYHKCNNECMESVRNGTYDYPKYSEESKLNREKIDGVKLDSMGVYRILAIYSTAASSLVLLVSLGAISFWMCSNGSLQCRICI

SEQ ID NO: 6367 - protein, 565 aa, Artificial Sequence
  hemagglutinin__InfluenzaA__ADV69108
MKVKLLVLLCTFTATYADTICVGYHANNSTDTVDTVLEKNVTVTHSVNLLEDSHNGKLCLLKGIAPLQLGSCSVAGWILGNPECELLISKESWSYIVETPNPENGTCYPGYFTDYEELREQLSSVSSFKRFEIFPKESSWPNHTVTGVSSSCSHNGKSSFYRNLLWLTMKNGLYPNLSKSYTNKKEKEVLVLWGVHHPSNIGDQRALYHTENAYVSVVSSHYSRRFTPEIAKRPKVRNQEGRINYYWTLLEPEDTIIFEANGNLIAPRYAFELSKGFGSGIITSNAPMGECNAKCQTPQGAINSSLPFQNVHPVTIGECPKYVRSSKLRMVTGLRNTPSIQSRGLFGAIAGFIEGGWTGMVDGWYGYHHQNEQGSGYAADQQSTQNAINGITNKVNSVIEKMNTQFTAVGKEFNKLERRMENLNKKIDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYNILAIYSTVASSLVLLVSLGAISFWMCSNGSLQCRICI

SEQ ID NO: 6368 - protein, 565 aa, Artificial Sequence
  hemagglutinin__InfluenzaA__ADV69109
MKVKLLILLCTFKATYADTICIGYHANNSTETVDTVLEKNVTVTHSVNLLEDSHNGKLCLLKGIAPLQLGNCSVAGWILGNPECESLISKKSWSYIVETPNPENGACYPGEFADYEELREQLSSVSSFERFEIFPKESSWPNHTATGVSASCSHNGERSFYRNLIWLTVKNGLYPNLSKSYENDKKKEVLILWGVHHPPNIENQRTLYHTENAYVSVVSSHYSGRFTPEITKRPKVRDQEGRINYYWTLLEPGDTIIFEANGNLIAPWYAFTLSRGLGSGIITSNAPMDECDAKCQTPKGAINSSLPFQNVHPVTIGECPKYVRSAKLRMVTGLRNIPSIQSRGLFGAIAGFIEGGWTGMVDGWYGYHHQNEQGSGYAADQESTQNAINGITNKVNSVIEKMNTQFTAVGKEFNKLERRMENLNKKVDDGFLDIWTYNAELLVLLENERTLDFHDSNVKSLYEKVKSQLKNNAKEIGNGCFEFYHKCNNECMESVKNGTYDYPKYSEESKLNREKIDGVKLDSMGVYRILAIYSTVASSLVLLVSLGAISFWMCSNGSLQCRICI

SEQ ID NO: 6369 - protein, 566 aa, Artificial Sequence
  hemagglutinin__InfluenzaA__ADV76579
MKTIIALSYILCLVFAQKLPGNDDSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6370 - protein, 566 aa, Artificial Sequence; identical to SEQ ID NO: 3588
  hemagglutinin__InfluenzaA__ADV76587

SEQ ID NO: 6371 - protein, 566 aa, Artificial Sequence; identical to SEQ ID NO: 3588
  hemagglutinin__InfluenzaA__ADV76598

SEQ ID NO: 6372 - protein, 566 aa, Artificial Sequence; identical to SEQ ID NO: 3411
  hemagglutinin__InfluenzaA__ADV76609

SEQ ID NO: 6373 - protein, 566 aa, Artificial Sequence; identical to SEQ ID NO: 3588
  hemagglutinin__InfluenzaA__ADV76620

SEQ ID NO: 6374 - protein, 566 aa, Artificial Sequence
  hemagglutinin__InfluenzaA__ADV76631
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTMVKPGDILLINSTGNLIAPRGYFKIRSGKSSIMRSDTPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKANEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6375 - protein, 566 aa, Artificial Sequence; identical to SEQ ID NO: 5592
  hemagglutinin__InfluenzaA__ADV76642

SEQ ID NO: 6376 - protein, 566 aa, Artificial Sequence; identical to SEQ ID NO: 5596
  hemagglutinin__InfluenzaA__ADV76664

SEQ ID NO: 6377 - protein, 566 aa, Artificial Sequence
  hemagglutinin__InfluenzaA__ADV76673
MKTIIALSYIFCLALGQDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIESRPWVRGLSSRISIYWTIVNPGDVLVINSNGNLIAPRGYFKMRTGKSSIMRSDAPIDTCISECITPNGSIPNDKPFQNVNKITYGACPKYVKQNTLKLATGMRNVPEKQTRGLFGAKAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 6378 - protein, 566 aa, Artificial Sequence
  hemagglutinin__InfluenzaA__ADV76682
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGESSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6379 - protein, 566 aa, Artificial Sequence; identical to SEQ ID NO: 3613
  hemagglutinin__InfluenzaA__ADV76694

SEQ ID NO: 6380 - protein, 566 aa, Artificial Sequence; identical to SEQ ID NO: 3411
  hemagglutinin__InfluenzaA__ADV76705

SEQ ID NO: 6381 - protein, 566 aa, Artificial Sequence; identical to SEQ ID NO: 3613
  hemagglutinin__InfluenzaA__ADV76716

SEQ ID NO: 6382 - protein, 566 aa, Artificial Sequence
  hemagglutinin__InfluenzaA__ADV76727
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGKSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6383 - protein, 566 aa, Artificial Sequence
  hemagglutinin__InfluenzaA__ADV91009
MKAILAVLLYTFATANADTLCIGYHANNSTDTVDTVLEKNVTVTHSVNLLEDKHNGKLCKLRGIAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKKVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVESTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6384 - protein, 566 aa, Artificial Sequence
  hemagglutinin__InfluenzaA__ADV91010
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFTDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6385 - protein, 566 aa, Artificial Sequence
  hemagglutinin__InfluenzaA__ADW01407
MEAKLFVLFCAFTALKADTICVGYHANNSTDTVDTILEKNVTVTHSVNLLENSHNGKLCSLNGKIPLQLGNCNVAGWILGNPKCDLLLTANSWSYIIETSNSKNGACYPGEFADYEELKEQLSTVSSFERFEIFPKATSWPNHDTTRGTTVACSHSGANSFYRNLLWIVKKGNSYPKLSKSYTNNKGKEVLVIWGVHHPPTDSDQQTLYQNNHTYVSVGSSKYYKRLTPEIVARPKVREQAGRMNYYWTLLDQGDTITFEATGNLIAPWHAFALKKGSSSGIMRSDAQVHNCTTKCQTPHGALKGNLPFQNVHPVTIGECPKYVKSTQLRMATGLRNIPSIQSRGLFGAIAGFIEGGWTGMVDGWYGYHHRNEQGSGYAADQKSTQIAIDGISNKVNSVIEKMNIQFTSVGKEFNSLEKRMENLNKKVDDGFLDVWTYNAELLILLENERTLDFHDLNVKNLYEKVKSQLRNNAKEIGNGCFEFYHKCDNECMESVKNGTYNYPKYSEESKLNREEIDGVKLESMGIHQILAIYSTVASSLVLLVSLGAISFWMCSNGSLQCRVCI

SEQ ID NO: 6386 - protein, 565 aa, Artificial Sequence; identical to SEQ ID NO: 3131
  hemagglutinin__InfluenzaA__ADW09101

SEQ ID NO: 6387 - protein, 565 aa, Artificial Sequence
  hemagglutinin__InfluenzaA__ADW09111
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNDQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6388 - protein, 565 aa, Artificial Sequence
  hemagglutinin__InfluenzaA__ADW09120
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYHTENAYVSVVSSHYSRKFTPEIAKRPKVRDQEGRINYYWTLLEPGDTIIFEANGNLIAPRYAFALSKGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6389 - protein, 565 aa, Artificial Sequence; identical to SEQ ID NO: 3616
  hemagglutinin__InfluenzaA__ADW09131

SEQ ID NO: 6390 - protein, 565 aa, Artificial Sequence
  hemagglutinin__InfluenzaA__ADW09153
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQDAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6391 - protein, 565 aa, Artificial Sequence; identical to SEQ ID NO: 3616
  hemagglutinin__InfluenzaA__ADW09164

SEQ ID NO: 6392 - protein, 565 aa, Artificial Sequence
  hemagglutinin__InfluenzaA__ADW09186
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNTPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6393 - protein, 565 aa, Artificial Sequence; identical to SEQ ID NO: 3131
  hemagglutinin__InfluenzaA__ADW09197

SEQ ID NO: 6394 - protein, 565 aa, Artificial Sequence; identical to SEQ ID NO: 3616
  hemagglutinin__InfluenzaA__ADW09208

SEQ ID NO: 6395 - protein, 565 aa, Artificial Sequence; identical to SEQ ID NO: 3616
  hemagglutinin__InfluenzaA__ADW09219

SEQ ID NO: 6396 - protein, 565 aa, Artificial Sequence; identical to SEQ ID NO: 3131
  hemagglutinin__InfluenzaA__ADW09230

SEQ ID NO: 6397 - protein, 565 aa, Artificial Sequence
  hemagglutinin__InfluenzaA__ADW09241
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEEMREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6398 - protein, 565 aa, Artificial Sequence; identical to SEQ ID NO: 3616
  hemagglutinin__InfluenzaA__ADW09252

SEQ ID NO: 6399 - protein, 565 aa, Artificial Sequence
  hemagglutinin__InfluenzaA__ADW09274
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKPYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6400 - protein, 565 aa, Artificial Sequence
  hemagglutinin__InfluenzaA__ADW09285
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTITFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6401 - protein, 565 aa, Artificial Sequence; identical to SEQ ID NO: 3616
  hemagglutinin__InfluenzaA__ADW09296

SEQ ID NO: 6402 - protein, 565 aa, Artificial Sequence; identical to SEQ ID NO: 3131
  hemagglutinin__InfluenzaA__ADW09307

SEQ ID NO: 6403 - protein, 565 aa, Artificial Sequence
  hemagglutinin__InfluenzaA__ADW09327
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 6404 - protein, 565 aa, Artificial Sequence; identical to SEQ ID NO: 3616
  hemagglutinin__InfluenzaA__ADW10483

SEQ ID NO: 6405 - protein, 565 aa, Artificial Sequence
  hemagglutinin__InfluenzaA__ADW10494
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6406 - protein, 565 aa, Artificial Sequence; identical to SEQ ID NO: 3616
  hemagglutinin__InfluenzaA__ADW10505

SEQ ID NO: 6407 - protein, 565 aa, Artificial Sequence; identical to SEQ ID NO: 3616
  hemagglutinin__InfluenzaA__ADW10516

SEQ ID NO: 6408 - protein, 565 aa, Artificial Sequence
  hemagglutinin__InfluenzaA__ADW10527
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGLGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6409 - protein, 565 aa, Artificial Sequence
  hemagglutinin__InfluenzaA__ADW10538
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVMSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6410 - protein, 565 aa, Artificial Sequence; identical to SEQ ID NO: 3616
  hemagglutinin__InfluenzaA__ADW10549

SEQ ID NO: 6411 - protein, 565 aa, Artificial Sequence
  hemagglutinin__InfluenzaA__ADW10560
MKVKLLVLLCTFTATYADTICIGYHANNSTDTVDTVFEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYRNLLWLTGKNGLYPNLSKSYANNKEKEVLVLWGVHHPPDIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6412 - protein, 565 aa, Artificial Sequence; identical to SEQ ID NO: 5953
  hemagglutinin__InfluenzaA__ADW10571

SEQ ID NO: 6413 - protein, 565 aa, Artificial Sequence; identical to SEQ ID NO: 3131
  hemagglutinin__InfluenzaA__ADW10582

SEQ ID NO: 6414 - protein, 565 aa, Artificial Sequence; identical to SEQ ID NO: 3616
  hemagglutinin__InfluenzaA__ADW10593

SEQ ID NO: 6415 - protein, 565 aa, Artificial Sequence; identical to SEQ ID NO: 3616
  hemagglutinin__InfluenzaA__ADW10604

SEQ ID NO: 6416 - protein, 565 aa, Artificial Sequence; identical to SEQ ID NO: 3616
  hemagglutinin__InfluenzaA__ADW10615

SEQ ID NO: 6417 - protein, 565 aa, Artificial Sequence
  hemagglutinin__InfluenzaA__ADW10626
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPSIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6418 - protein, 565 aa, Artificial Sequence
  hemagglutinin__InfluenzaA__ADW10721
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFKRFEIFPKESSWPNHTVTGVSASCSHNGESSFYRNLLWLTVKNGLYPNLSKSYANNKEKEVLVLWGVHHPPNIVDQRTLYHTENAYVSVVSSHYSRKFTPEIAKRPKVRNQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6419 - protein, 565 aa, Artificial Sequence
  hemagglutinin__InfluenzaA__ADW10743
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENTYVSVVSSHYSRKFTPEIAKRPKIRDQEGRINYYWTLLEPGDTIIFEANGNLIAPRYAFALSRGFGSGIINSNAPMDKCDAKCQTPRGAINSSLPFQNVHPVTIGECPKYVRSVKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6420 - protein, 565 aa, Artificial Sequence
  hemagglutinin__InfluenzaA__ADW10754
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSVQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6421 - protein, 565 aa, Artificial Sequence
  hemagglutinin__InfluenzaA__ADW10765
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYHTENAYVSVVSSHYSRKFTPEIAKRPKVRNQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6422 - protein, 565 aa, Artificial Sequence
  hemagglutinin__InfluenzaA__ADW10776
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANDKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6423 - protein, 565 aa, Artificial Sequence
  hemagglutinin__InfluenzaA__ADW10787
MKVKILVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6424 - protein, 565 aa, Artificial Sequence
  hemagglutinin__InfluenzaA__ADW10798
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRVENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6425 - protein, 565 aa, Artificial Sequence; identical to SEQ ID NO: 6421
  hemagglutinin__InfluenzaA__ADW10809

SEQ ID NO: 6426 - protein, 565 aa, Artificial Sequence; identical to SEQ ID NO: 3616
  hemagglutinin__InfluenzaA__ADW10820

SEQ ID NO: 6427 - protein, 565 aa, Artificial Sequence; identical to SEQ ID NO: 3131
  hemagglutinin__InfluenzaA__ADW10831

SEQ ID NO: 6428 - protein, 565 aa, Artificial Sequence
  hemagglutinin__InfluenzaA__ADW10842
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFAPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6429 - protein, 565 aa, Artificial Sequence; identical to SEQ ID NO: 5972
  hemagglutinin__InfluenzaA__ADW10853

SEQ ID NO: 6430 - protein, 565 aa, Artificial Sequence; identical to SEQ ID NO: 6421
  hemagglutinin__InfluenzaA__ADW10864

SEQ ID NO: 6431 - protein, 565 aa, Artificial Sequence; identical to SEQ ID NO: 6421
  hemagglutinin__InfluenzaA__ADW10875

SEQ ID NO: 6432 - protein, 565 aa, Artificial Sequence; identical to SEQ ID NO: 3616
  hemagglutinin__InfluenzaA__ADW10886

SEQ ID NO: 6433 - protein, 565 aa, Artificial Sequence
  hemagglutinin__InfluenzaA__ADW10897
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISDQKTLYHTENAYVSVVSSHYSRKFTPEIAKRPKVRDQEGRINYYWTLLEPGDTIIFEANGNLIAPRYAFALSRGFGSGIINSNAPMDKCDTKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEVGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6434 - protein, 566 aa, Artificial Sequence
  hemagglutinin__InfluenzaA__ADW23115
MKTIIALSYILCLVFAQKLPGNGNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6435 - protein, 566 aa, Artificial Sequence
  hemagglutinin__InfluenzaA__ADW54481
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6436 - protein, 566 aa, Artificial Sequence
  hemagglutinin__InfluenzaA__ADW54512
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFKRFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6437 - protein, 566 aa, Artificial Sequence
  hemagglutinin__InfluenzaA__ADW54527
MKAILVVLLYTFATASADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPNGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6438 - protein, 566 aa, Artificial Sequence; identical to SEQ ID NO: 6435
  hemagglutinin__InfluenzaA__ADW65825

SEQ ID NO: 6439 - protein, 566 aa, Artificial Sequence
  hemagglutinin__InfluenzaA__ADW82135
MKTIIALSYILCLVFAQKLPGNDNSTATLCLGHHAVPNGTVVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYTALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6440 - protein, 566 aa, Artificial Sequence; identical to SEQ ID NO: 6439
  hemagglutinin__InfluenzaA__ADW82155

SEQ ID NO: 6441 - protein, 566 aa, Artificial Sequence; identical to SEQ ID NO: 6439
  hemagglutinin__InfluenzaA__ADW82166

SEQ ID NO: 6442 - protein, 566 aa, Artificial Sequence; identical to SEQ ID NO: 6439
  hemagglutinin__InfluenzaA__ADW82177

SEQ ID NO: 6443 - protein, 566 aa, Artificial Sequence; identical to SEQ ID NO: 2669
  hemagglutinin__InfluenzaA__ADW82188

SEQ ID NO: 6444 - protein, 566 aa, Artificial Sequence; identical to SEQ ID NO: 2669
  hemagglutinin__InfluenzaA__ADW82198

SEQ ID NO: 6445 - protein, 566 aa, Artificial Sequence; identical to SEQ ID NO: 2669
  hemagglutinin__InfluenzaA__ADW82208

SEQ ID NO: 6446 - protein, 566 aa, Artificial Sequence; identical to SEQ ID NO: 2669
  hemagglutinin__InfluenzaA__ADW82218

SEQ ID NO: 6447 - protein, 566 aa, Artificial Sequence; identical to SEQ ID NO: 2669
  hemagglutinin__InfluenzaA__ADW82228

SEQ ID NO: 6448 - protein, 566 aa, Artificial Sequence; identical to SEQ ID NO: 2669
  hemagglutinin__InfluenzaA__ADW82238

SEQ ID NO: 6449 - protein, 566 aa, Artificial Sequence; identical to SEQ ID NO: 2669
  hemagglutinin__InfluenzaA__ADW82248

SEQ ID NO: 6450 - protein, 566 aa, Artificial Sequence; identical to SEQ ID NO: 2669
  hemagglutinin__InfluenzaA__ADW82258

SEQ ID NO: 6451 - protein, 566 aa, Artificial Sequence
  hemagglutinin__InfluenzaA__ADW82268
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIHQILAIYSTVASSLVLVVSLGAISFWMCSNGSLQCRICI

SEQ ID NO: 6452 - protein, 566 aa, Artificial Sequence; identical to SEQ ID NO: 6439
  hemagglutinin__InfluenzaA__ADW93760

SEQ ID NO: 6453 - protein, 566 aa, Artificial Sequence
  hemagglutinin__InfluenzaA__ADW95319
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6454 - protein, 566 aa, Artificial Sequence
  hemagglutinin__InfluenzaA__ADW95332
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6455 - protein, 566 aa, Artificial Sequence
  hemagglutinin__InfluenzaA__ADX21078
MKTIIALSYILCLVFAQKLPGNDNSTATLCLGHHAVPNGTVVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYTALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIRKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6456 - protein, 566 aa, Artificial Sequence; identical to SEQ ID NO: 6455
  hemagglutinin__InfluenzaA__ADX21088

SEQ ID NO: 6457 - protein, 566 aa, Artificial Sequence
  hemagglutinin__InfluenzaA__ADX21098
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCSTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIHQILAIYSTVASSLVLVVSLGAISFWMCSNGSLQCRICI

SEQ ID NO: 6458 - protein, 566 aa, Artificial Sequence; identical to SEQ ID NO: 3588
  hemagglutinin__InfluenzaA__ADX36109

SEQ ID NO: 6459 - protein, 566 aa, Artificial Sequence
  hemagglutinin__InfluenzaA__ADX96278
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAVNTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 6460 - protein, 566 aa, Artificial Sequence
  hemagglutinin__InfluenzaA__ADX96288
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKQGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 6461 - protein, 566 aa, Artificial Sequence
  hemagglutinin__InfluenzaA__ADX96298
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIVIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSTGSLQCRICI

SEQ ID NO: 6462 - protein, 566 aa, Artificial Sequence; identical to SEQ ID NO: 4266
  hemagglutinin__InfluenzaA__ADX96308

SEQ ID NO: 6463 - protein, 566 aa, Artificial Sequence
  hemagglutinin__InfluenzaA__ADX96318
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6464 - protein, 566 aa, Artificial Sequence
  hemagglutinin__InfluenzaA__ADX96328
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6465 - protein, 566 aa, Artificial Sequence
  hemagglutinin__InfluenzaA__ADX96347
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHNCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6466 - protein, 566 aa, Artificial Sequence
  hemagglutinin__InfluenzaA__ADX96357
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIVIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6467 - protein, 566 aa, Artificial Sequence; identical to SEQ ID NO: 5606
  hemagglutinin__InfluenzaA__ADX96367

SEQ ID NO: 6468 - protein, 566 aa, Artificial Sequence
  hemagglutinin__InfluenzaA__ADX96378
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6469 - protein, 566 aa, Artificial Sequence; identical to SEQ ID NO: 6468
  hemagglutinin__InfluenzaA__ADX96398

SEQ ID NO: 6470 - protein, 566 aa, Artificial Sequence
  hemagglutinin__InfluenzaA__ADX96408
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6471 - protein, 566 aa, Artificial Sequence; identical to SEQ ID NO: 2982
  hemagglutinin__InfluenzaA__ADX96427

SEQ ID NO: 6472 - protein, 566 aa, Artificial Sequence
  hemagglutinin__InfluenzaA__ADX96437
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRLENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 6473 - protein, 566 aa, Artificial Sequence; identical to SEQ ID NO: 2656
  hemagglutinin__InfluenzaA__ADX96447

SEQ ID NO: 6474 - protein, 566 aa, Artificial Sequence; identical to SEQ ID NO: 2669
  hemagglutinin__InfluenzaA__ADX96497

SEQ ID NO: 6475 - protein, 566 aa, Artificial Sequence
  hemagglutinin__InfluenzaA__ADX96507
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSTGSLQCRICI

SEQ ID NO: 6476 - protein, 566 aa, Artificial Sequence; identical to SEQ ID NO: 6475
  hemagglutinin__InfluenzaA__ADX96517

SEQ ID NO: 6477 - protein, 566 aa, Artificial Sequence
  hemagglutinin__InfluenzaA__ADX96527
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFFHKCDNTCMESVKNGTYDYPKYSEEAKLNREEIDGVKLESTRIYQILAIYSTVASSLVLVVSLGAISFWMCSNGSLQCRICI

SEQ ID NO: 6478 - protein, 566 aa, Artificial Sequence; identical to SEQ ID NO: 2669
  hemagglutinin__InfluenzaA__ADX96537

SEQ ID NO: 6479 - protein, 566 aa, Artificial Sequence; identical to SEQ ID NO: 2669
  hemagglutinin__InfluenzaA__ADX96547

SEQ ID NO: 6480 - protein, 566 aa, Artificial Sequence; identical to SEQ ID NO: 3770
  hemagglutinin__InfluenzaA__ADX96557

SEQ ID NO: 6481 - protein, 566 aa, Artificial Sequence; identical to SEQ ID NO: 2669
  hemagglutinin__InfluenzaA__ADX96587

SEQ ID NO: 6482 - protein, 566 aa, Artificial Sequence; identical to SEQ ID NO: 2656
  hemagglutinin__InfluenzaA__ADX96597

SEQ ID NO: 6483 - protein, 566 aa, Artificial Sequence; identical to SEQ ID NO: 2656
  hemagglutinin__InfluenzaA__ADX96607

SEQ ID NO: 6484 - protein, 566 aa, Artificial Sequence
  hemagglutinin__InfluenzaA__ADX96627
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSTGSLQCRICI

SEQ ID NO: 6485 - protein, 566 aa, Artificial Sequence; identical to SEQ ID NO: 3116
  hemagglutinin__InfluenzaA__ADX96637

SEQ ID NO: 6486 - protein, 566 aa, Artificial Sequence; identical to SEQ ID NO: 2669
  hemagglutinin__InfluenzaA__ADX96647

SEQ ID NO: 6487 - protein, 566 aa, Artificial Sequence; identical to SEQ ID NO: 2656
  hemagglutinin__InfluenzaA__ADX96657

SEQ ID NO: 6488 - protein, 566 aa, Artificial Sequence; identical to SEQ ID NO: 2669
  hemagglutinin__InfluenzaA__ADX96667

SEQ ID NO: 6489 - protein, 566 aa, Artificial Sequence
  hemagglutinin__InfluenzaA__ADX96677
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTVVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6490 - protein, 566 aa, Artificial Sequence
  hemagglutinin__InfluenzaA__ADX96687
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFKRFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVYDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6491 - protein, 566 aa, Artificial Sequence; identical to SEQ ID NO: 2669
  hemagglutinin__InfluenzaA__ADX96697

SEQ ID NO: 6492 - protein, 566 aa, Artificial Sequence
  hemagglutinin__InfluenzaA__ADX96707
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCDTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSTGSLQCRICI

SEQ ID NO: 6493 - protein, 566 aa, Artificial Sequence; identical to SEQ ID NO: 3829
  hemagglutinin__InfluenzaA__ADX96727

SEQ ID NO: 6494 - protein, 566 aa, Artificial Sequence
  hemagglutinin__InfluenzaA__ADX96737
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVKEQEGRMNYYWTLVEPGDKITFEATGNLVVPRYAFAMERKAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVISLGAISFWMCSTGSLQCRICI

SEQ ID NO: 6495 - protein, 566 aa, Artificial Sequence; identical to SEQ ID NO: 2669
  hemagglutinin__InfluenzaA__ADX96747

SEQ ID NO: 6496 - protein, 566 aa, Artificial Sequence
  hemagglutinin__InfluenzaA__ADX96757
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVVPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSTGSLQCRICI

SEQ ID NO: 6497 - protein, 566 aa, Artificial Sequence
  hemagglutinin__InfluenzaA__ADX96767
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVESGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSTGSLQCRICI

SEQ ID NO: 6498 - protein, 566 aa, Artificial Sequence
  hemagglutinin__InfluenzaA__ADX96777
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVVPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6499 - protein, 566 aa, Artificial Sequence; identical to SEQ ID NO: 2669
  hemagglutinin__InfluenzaA__ADX96787

SEQ ID NO: 6500 - protein, 566 aa, Artificial Sequence; identical to SEQ ID NO: 5896
  hemagglutinin__InfluenzaA__ADX96797

SEQ ID NO: 6501 - protein, 566 aa, Artificial Sequence
  hemagglutinin__InfluenzaA__ADX96807
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRFSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6502 - protein, 566 aa, Artificial Sequence; identical to SEQ ID NO: 2656
  hemagglutinin__InfluenzaA__ADX96817

SEQ ID NO: 6503 - protein, 566 aa, Artificial Sequence
  hemagglutinin__InfluenzaA__ADX96837
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPYAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSTGSLQCRICI

SEQ ID NO: 6504 - protein, 566 aa, Artificial Sequence; identical to SEQ ID NO: 2669
  hemagglutinin__InfluenzaA__ADX96847

SEQ ID NO: 6505 - protein, 566 aa, Artificial Sequence; identical to SEQ ID NO: 2669
  hemagglutinin__InfluenzaA__ADX96857

SEQ ID NO: 6506 - protein, 566 aa, Artificial Sequence; identical to SEQ ID NO: 2849
  hemagglutinin__InfluenzaA__ADX96867

SEQ ID NO: 6507 - protein, 566 aa, Artificial Sequence; identical to SEQ ID NO: 5606
  hemagglutinin__InfluenzaA__ADX96877

SEQ ID NO: 6508 - protein, 566 aa, Artificial Sequence
  hemagglutinin__InfluenzaA__ADX96897
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6509 - protein, 566 aa, Artificial Sequence
  hemagglutinin__InfluenzaA__ADX96907
MKAILVVLLYTFATANADTLCIGYHANNSTDTVDTVLEKNVTVTHSVNLLEDKHSGKLCKLRGVAPLHLGKCNIAGWILGNPECESLSTASSWSYIVETSSSDNGTCYPGDFIDYEELREQLSSVSSFERFEIFPKTSSWPNHDSSKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6510 - protein, 566 aa, Artificial Sequence
  hemagglutinin__InfluenzaA__ADX96927
MKAILVVLLYTFATANADTLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMDRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6511 - protein, 566 aa, Artificial Sequence; identical to SEQ ID NO: 4089
  hemagglutinin__InfluenzaA__ADX96937

SEQ ID NO: 6512 - protein, 566 aa, Artificial Sequence; identical to SEQ ID NO: 2656
  hemagglutinin__InfluenzaA__ADX96947

SEQ ID NO: 6513 - protein, 566 aa, Artificial Sequence; identical to SEQ ID NO: 3833
  hemagglutinin__InfluenzaA__ADX96957

SEQ ID NO: 6514 - protein, 566 aa, Artificial Sequence; identical to SEQ ID NO: 2982
  hemagglutinin__InfluenzaA__ADX96967

SEQ ID NO: 6515 - protein, 566 aa, Artificial Sequence; identical to SEQ ID NO: 2849
  hemagglutinin__InfluenzaA__ADX96977

SEQ ID NO: 6516 - protein, 566 aa, Artificial Sequence
  hemagglutinin__InfluenzaA__ADX96987
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGIKLESTRIYQILAIYSTVASSLVLVVSLGAISFWMCSNGSLQCRICI

SEQ ID NO: 6517 - protein, 566 aa, Artificial Sequence; identical to SEQ ID NO: 2849
  hemagglutinin__InfluenzaA__ADX96997

SEQ ID NO: 6518 - protein, 566 aa, Artificial Sequence
  hemagglutinin__InfluenzaA__ADX97007
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDAPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6519 - protein, 566 aa, Artificial Sequence; identical to SEQ ID NO: 6468
  hemagglutinin__InfluenzaA__ADX97018

SEQ ID NO: 6520 - protein, 566 aa, Artificial Sequence
  hemagglutinin__InfluenzaA__ADX97028
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKQGNSYPKLSKSYINDKGKEVLVLWGIHHPSTTADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 6521 - protein, 566 aa, Artificial Sequence; identical to SEQ ID NO: 5222
  hemagglutinin__InfluenzaA__ADX98640

SEQ ID NO: 6522 - protein, 566 aa, Artificial Sequence; identical to SEQ ID NO: 4221
  hemagglutinin__InfluenzaA__ADX98650

SEQ ID NO: 6523 - protein, 566 aa, Artificial Sequence
  hemagglutinin__InfluenzaA__ADX98665
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 6524 - protein, 566 aa, Artificial Sequence; identical to SEQ ID NO: 3833
  hemagglutinin__InfluenzaA__ADX98675

SEQ ID NO: 6525 - protein, 566 aa, Artificial Sequence; identical to SEQ ID NO: 3833
  hemagglutinin__InfluenzaA__ADX98695

SEQ ID NO: 6526 - protein, 566 aa, Artificial Sequence; identical to SEQ ID NO: 4221
  hemagglutinin__InfluenzaA__ADX98729

SEQ ID NO: 6527 - protein, 566 aa, Artificial Sequence; identical to SEQ ID NO: 5552
  hemagglutinin__InfluenzaA__ADX98739

SEQ ID NO: 6528 - protein, 566 aa, Artificial Sequence; identical to SEQ ID NO: 5301
  hemagglutinin__InfluenzaA__ADX98748

SEQ ID NO: 6529 - protein, 566 aa, Artificial Sequence; identical to SEQ ID NO: 2669
  hemagglutinin__InfluenzaA__ADX98758

SEQ ID NO: 6530 - protein, 566 aa, Artificial Sequence; identical to SEQ ID NO: 3022
  hemagglutinin__InfluenzaA__ADX98767

SEQ ID NO: 6531 - protein, 566 aa, Artificial Sequence; identical to SEQ ID NO: 4266
  hemagglutinin__InfluenzaA__ADX98777

SEQ ID NO: 6532 - protein, 566 aa, Artificial Sequence
  hemagglutinin__InfluenzaA__ADX98785
MKAILVVLLYTLATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIGGVKLESTRIYQILAIYSTVASSLVLVVSLGAISFWMCSNGSLQCRICI

SEQ ID NO: 6533 - protein, 566 aa, Artificial Sequence; identical to SEQ ID NO: 3770
  hemagglutinin__InfluenzaA__ADX98792

SEQ ID NO: 6534 - protein, 566 aa, Artificial Sequence; identical to SEQ ID NO: 3770
  hemagglutinin__InfluenzaA__ADX98806

SEQ ID NO: 6535 - protein, 566 aa, Artificial Sequence; identical to SEQ ID NO: 5710
  hemagglutinin__InfluenzaA__ADX98818

SEQ ID NO: 6536 - protein, 566 aa, Artificial Sequence; identical to SEQ ID NO: 2669
  hemagglutinin__InfluenzaA__ADX98828

SEQ ID NO: 6537 - protein, 566 aa, Artificial Sequence; identical to SEQ ID NO: 6060
  hemagglutinin__InfluenzaA__ADX98843

SEQ ID NO: 6538 - protein, 566 aa, Artificial Sequence
  hemagglutinin__InfluenzaA__ADX98853
MKAILVVLLYTFATANADTLCIGYHANNSTDTVDTVLEKNVTVTHSVNLLEDKHNGKLCKLRGVAPLHLGKCNIAGWILGNPECESLSIASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6539 - protein, 566 aa, Artificial Sequence; identical to SEQ ID NO: 3833
  hemagglutinin__InfluenzaA__ADX98860

SEQ ID NO: 6540 - protein, 566 aa, Artificial Sequence; identical to SEQ ID NO: 5221
  hemagglutinin__InfluenzaA__ADX98870

SEQ ID NO: 6541 - protein, 566 aa, Artificial Sequence
  hemagglutinin__InfluenzaA__ADX98880
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSIIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6542 - protein, 566 aa, Artificial Sequence
  hemagglutinin__InfluenzaA__ADX98890
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAESGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6543 - protein, 566 aa, Artificial Sequence; identical to SEQ ID NO: 4221
  hemagglutinin__InfluenzaA__ADX98900

SEQ ID NO: 6544 - protein, 566 aa, Artificial Sequence
  hemagglutinin__InfluenzaA__ADX98910
MKAILVVLLYTFATANADTLCIGYHANNSTDTVDTVLEKNVTVTHSVNLLEDKHNGKLCKLRGVAPLHLGKCNIAGWILGNPECESLSTAISWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6545 - protein, 566 aa, Artificial Sequence; identical to SEQ ID NO: 4221
  hemagglutinin__InfluenzaA__ADX98920

SEQ ID NO: 6546 - protein, 566 aa, Artificial Sequence; identical to SEQ ID NO: 3833
  hemagglutinin__InfluenzaA__ADX98930

SEQ ID NO: 6547 - protein, 566 aa, Artificial Sequence; identical to SEQ ID NO: 3460
  hemagglutinin__InfluenzaA__ADX98940

SEQ ID NO: 6548 - protein, 566 aa, Artificial Sequence; identical to SEQ ID NO: 5289
  hemagglutinin__InfluenzaA__ADX98950

SEQ ID NO: 6549 - protein, 566 aa, Artificial Sequence; identical to SEQ ID NO: 5270
  hemagglutinin__InfluenzaA__ADX98960

SEQ ID NO: 6550 - protein, 566 aa, Artificial Sequence
  hemagglutinin__InfluenzaA__ADX98970
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQGLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6551 - protein, 566 aa, Artificial Sequence; identical to SEQ ID NO: 3770
  hemagglutinin__InfluenzaA__ADX98980

SEQ ID NO: 6552 - protein, 566 aa, Artificial Sequence; identical to SEQ ID NO: 2669
  hemagglutinin__InfluenzaA__ADX98990

SEQ ID NO: 6553 - protein, 566 aa, Artificial Sequence; identical to SEQ ID NO: 3833
  hemagglutinin__InfluenzaA__ADX99000

SEQ ID NO: 6554 - protein, 565 aa, Artificial Sequence
  hemagglutinin__InfluenzaA__ADX99581
MKANLLVLLSALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNTPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6555 - protein, 565 aa, Artificial Sequence; identical to SEQ ID NO: 6554
  hemagglutinin__InfluenzaA__ADX99592

SEQ ID NO: 6556 - protein, 565 aa, Artificial Sequence; identical to SEQ ID NO: 6554
  hemagglutinin__InfluenzaA__ADX99603

SEQ ID NO: 6557 - protein, 565 aa, Artificial Sequence
  hemagglutinin__InfluenzaA__ADX99614
MKANLLVLLSALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKKGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNTPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6558 - protein, 565 aa, Artificial Sequence
  hemagglutinin__InfluenzaA__ADX99625
MKANLLVLLSALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFGANGNLIAPMYAFALSRGFGSGIITSNASMHECNTKCQTPLGAINSSLPYQNIHPVTIGECPKYVRSAKLRMVTGLRNTPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6559 - protein, 565 aa, Artificial Sequence
  hemagglutinin__InfluenzaA__ADX99636
MKANLLVLLSALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTKKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNTPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6560 - protein, 565 aa, Artificial Sequence; identical to SEQ ID NO: 3278
  hemagglutinin__InfluenzaA__ADX99647

SEQ ID NO: 6561 - protein, 565 aa, Artificial Sequence
  hemagglutinin__InfluenzaA__ADX99680
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWSNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6562 - protein, 565 aa, Artificial Sequence
  hemagglutinin__InfluenzaA__ADX99702
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKKSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6563 - protein, 565 aa, Artificial Sequence; identical to SEQ ID NO: 6562
  hemagglutinin__InfluenzaA__ADX99843

SEQ ID NO: 6564 - protein, 565 aa, Artificial Sequence
  hemagglutinin__InfluenzaA__ADX99854
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYLKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6565 - protein, 565 aa, Artificial Sequence
  hemagglutinin__InfluenzaA__ADX99865
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKQKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6566 - protein, 565 aa, Artificial Sequence
  hemagglutinin__InfluenzaA__ADX99887
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLENSYVNKKGKEVLVLWGIHHPPNSKEQQNLYQNENAYVSVVTSNYNRRFTPEIAERSKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6567 - protein, 565 aa, Artificial Sequence
  hemagglutinin__InfluenzaA__ADX99898
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNYYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6568 - protein, 565 aa, Artificial Sequence
  hemagglutinin__InfluenzaA__ADX99909
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNFYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6569 - protein, 565 aa, Artificial Sequence; identical to SEQ ID NO: 6568
  hemagglutinin__InfluenzaA__ADX99920

SEQ ID NO: 6570 - protein, 565 aa, Artificial Sequence
  hemagglutinin__InfluenzaA__ADX99931
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLENSYVNKKGKEVLVLWGIHHPPNSKEQQNLYQNENAYVSVVTSNYNRRFTPEIAGRPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNRCFEFYHKCDNECMESVRNGTYDYPKYSEESKLNREKVDGVKLESMGIYQILAIYSTVASSLVLLVSLGAISFWMCSNGSLQCRICI

SEQ ID NO: 6571 - protein, 565 aa, Artificial Sequence
  hemagglutinin__InfluenzaA__ADX99964
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPKHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6572 - protein, 565 aa, Artificial Sequence
  hemagglutinin__InfluenzaA__ADX99975
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTATCSHEGKSSFYRNLLWLTEKEGSYPELKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6573 - protein, 565 aa, Artificial Sequence
  hemagglutinin__InfluenzaA__ADX99986
MKANLLVLLCALAAADADTICIGYHANNSTDTVDTVLEKNVTVTHSVNLLEDSHNGKLCRLKGIAPLQLGKCNIAGWLLGNPKCDPLLPVRSWSYIVETPNSENGICYPGDFIDYEELREQLSSVSSFERFEIFPKESSWPNHNTNGVTAACSHEGKSSFYRNLLWLTEKEGSYPKLENSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6574 - protein, 565 aa, Artificial Sequence
  hemagglutinin__InfluenzaA__ADX99997
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLENSYVNKKGKEVLVLWGIHHPPNSKEQQNLYQNENAYVSVVTSNYNRRFTPEIAERPKVRDQAGRMKYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6575 - protein, 565 aa, Artificial Sequence
  hemagglutinin__InfluenzaA__ADY00009
MKANLLVLLCALAAADADTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKKGSYPKLENSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 6576 - protein, 565 aa, Artificial Sequence; identical to SEQ ID NO: 3278
  hemagglutinin__InfluenzaA__ADY00020

SEQ ID NO: 6577 - protein, 565 aa, Artificial Sequence
  hemagglutinin__InfluenzaA__ADY04727
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNLKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 6578 - protein, 566 aa, Artificial Sequence; identical to SEQ ID NO: 3613
  hemagglutinin__InfluenzaA__ADY11836

SEQ ID NO: 6579 - protein, 566 aa, Artificial Sequence; identical to SEQ ID NO: 3588
  hemagglutinin__InfluenzaA__ADY17654

SEQ ID NO: 6580 - protein, 566 aa, Artificial Sequence
  hemagglutinin__InfluenzaA__ADY17665
MKTIIALSYILCLIFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQDGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6581 - protein, 566 aa, Artificial Sequence; identical to SEQ ID NO: 3613
  hemagglutinin__InfluenzaA__ADY17676

SEQ ID NO: 6582 - protein, 566 aa, Artificial Sequence
  hemagglutinin__InfluenzaA__ADY17687
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQDGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCAALLGFIMWACQKGNIRCNICI

SEQ ID NO: 6583 - protein, 566 aa, Artificial Sequence; identical to SEQ ID NO: 3588
  hemagglutinin__InfluenzaA__ADY17698

SEQ ID NO: 6584 - protein, 566 aa, Artificial Sequence
  hemagglutinin__InfluenzaA__ADY38719
MKTIIALSYILCLVFTQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6585 - protein, 566 aa, Artificial Sequence; identical to SEQ ID NO: 2669
  hemagglutinin__InfluenzaA__ADY38750

SEQ ID NO: 6586 - protein, 566 aa, Artificial Sequence; identical to SEQ ID NO: 3833
  hemagglutinin__InfluenzaA__ADY38760

SEQ ID NO: 6587 - protein, 566 aa, Artificial Sequence
  hemagglutinin__InfluenzaA__ADZ04607
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 6588 - protein, 565 aa, Artificial Sequence; identical to SEQ ID NO: 5963
  hemagglutinin__InfluenzaA__ADZ05834

SEQ ID NO: 6589 - protein, 565 aa, Artificial Sequence
  hemagglutinin__InfluenzaA__ADZ05845
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNMADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6590 - protein, 566 aa, Artificial Sequence; identical to SEQ ID NO: 2434
  hemagglutinin__InfluenzaA__ADZ05855

SEQ ID NO: 6591 - protein, 566 aa, Artificial Sequence
  hemagglutinin__InfluenzaA__ADZ47838
MKAILVVLLYTLATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSFVLIVSLGAISFWMCSNGSLQCRICI

SEQ ID NO: 6592 - protein, 566 aa, Artificial Sequence; identical to SEQ ID NO: 3841
  hemagglutinin__InfluenzaA__ADZ47858

SEQ ID NO: 6593 - protein, 565 aa, Artificial Sequence
  hemagglutinin__InfluenzaA__ADZ53100
MKVKLLVLLCTFTATYADTICIGYHANNSTDTVDTVLEKNVTVTHSVNLLENSHNGKLCLLKGIAPLQLGNCSVAGWILGNPECELLISKETWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSINDQKTLYHTENAYVSVVSSHYSRKFTPEIAKRPKVRDQEGRINYYWTLLEPRDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6594 - protein, 566 aa, Artificial Sequence; identical to SEQ ID NO: 3116
  hemagglutinin__InfluenzaA__ADZ53123

SEQ ID NO: 6595 - protein, 566 aa, Artificial Sequence; identical to SEQ ID NO: 2911
  hemagglutinin__InfluenzaA__ADZ53125

SEQ ID NO: 6596 - protein, 566 aa, Artificial Sequence; identical to SEQ ID NO: 3293
  hemagglutinin__InfluenzaA__ADZ53127

SEQ ID NO: 6597 - protein, 566 aa, Artificial Sequence; identical to SEQ ID NO: 2656
  hemagglutinin__InfluenzaA__ADZ53131

SEQ ID NO: 6598 - protein, 566 aa, Artificial Sequence; identical to SEQ ID NO: 2669
  hemagglutinin__InfluenzaA__ADZ53133

SEQ ID NO: 6599 - protein, 566 aa, Artificial Sequence; identical to SEQ ID NO: 2911
  hemagglutinin__InfluenzaA__ADZ53135

SEQ ID NO: 6600 - protein, 566 aa, Artificial Sequence; identical to SEQ ID NO: 3833
  hemagglutinin__InfluenzaA__ADZ53138

SEQ ID NO: 6601 - protein, 566 aa, Artificial Sequence; identical to SEQ ID NO: 2669
  hemagglutinin__InfluenzaA__ADZ53140

SEQ ID NO: 6602 - protein, 566 aa, Artificial Sequence; identical to SEQ ID NO: 3116
  hemagglutinin__InfluenzaA__ADZ93496

SEQ ID NO: 6603 - protein, 562 aa, Artificial Sequence; identical to SEQ ID NO: 2350
  hemagglutinin__InfluenzaA__AEA04365

SEQ ID NO: 6604 - protein, 562 aa, Artificial Sequence
  hemagglutinin__InfluenzaA__AEA04376
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTEKGSNYPVAKGSYNNTSGEQMLIIWGVHHPNDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKVEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 6605 - protein, 565 aa, Artificial Sequence
  hemagglutinin__InfluenzaA__AEA10292
MKVKLLVLLCTFTATYADTICIGYHANNSTDTVDTVLEKNVTVTHSVNLLENSHNGKLCSLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6606 - protein, 566 aa, Artificial Sequence; identical to SEQ ID NO: 5268
  hemagglutinin__InfluenzaA__AEA10303

SEQ ID NO: 6607 - protein, 566 aa, Artificial Sequence; identical to SEQ ID NO: 6122
  hemagglutinin__InfluenzaA__AEA10313

SEQ ID NO: 6608 - protein, 566 aa, Artificial Sequence; identical to SEQ ID NO: 3833
  hemagglutinin__InfluenzaA__AEA10323

SEQ ID NO: 6609 - protein, 566 aa, Artificial Sequence; identical to SEQ ID NO: 4221
  hemagglutinin__InfluenzaA__AEA10339

SEQ ID NO: 6610 - protein, 566 aa, Artificial Sequence
  hemagglutinin__InfluenzaA__AEA10349
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6611 - protein, 566 aa, Artificial Sequence; identical to SEQ ID NO: 4266
  hemagglutinin__InfluenzaA__AEA30293

SEQ ID NO: 6612 - protein, 566 aa, Artificial Sequence
  hemagglutinin__InfluenzaA__AEA48989
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHESNKGVTAACPHAGARSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6613 - protein, 568 aa, Artificial Sequence
  hemagglutinin__InfluenzaA__AEA50985
MEKIVLLLAIINLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKNDAYPTIKISYNNTNQEDLLVLWGIHHPNDAAEQTKLYQNPTTYISVGTSTLNLRLVPKIATRSKVNGQSGRMEFFWTILKPNDAINFESNGNFIAPENAYKIVKKGDSTIMKSELEYGNCNTKCQTPVGAINSSMPFHNIHPLTIGECPKYVKSNRLVLATGLRNSPQGERRRKKRGLFGAIAGFIEGGWQGMVDGWYGYHHSNEQGSGYAADKESTQKAINGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEESRLKREEISGVKLESIGIYQILSIYSTAASSLALAIMVAGLSLWMCSNGSLQCRICI

SEQ ID NO: 6614 - protein, 566 aa, Artificial Sequence; identical to SEQ ID NO: 5533
  hemagglutinin__InfluenzaA__AEA72704

SEQ ID NO: 6615 - protein, 566 aa, Artificial Sequence; identical to SEQ ID NO: 5533
  hemagglutinin__InfluenzaA__AEA72715

SEQ ID NO: 6616 - protein, 566 aa, Artificial Sequence; identical to SEQ ID NO: 5533
  hemagglutinin__InfluenzaA__AEA72726

SEQ ID NO: 6617 - protein, 566 aa, Artificial Sequence
  hemagglutinin__InfluenzaA__AEA72740
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIATRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6618 - protein, 566 aa, Artificial Sequence
  hemagglutinin__InfluenzaA__AEA72750
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGVFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6619 - protein, 566 aa, Artificial Sequence; identical to SEQ ID NO: 6435
  hemagglutinin__InfluenzaA__AEA72759

SEQ ID NO: 6620 - protein, 566 aa, Artificial Sequence
  hemagglutinin__InfluenzaA__AEA72777
MKAILVVLLYTLATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEILVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNATCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6621 - protein, 566 aa, Artificial Sequence; identical to SEQ ID NO: 6435
  hemagglutinin__InfluenzaA__AEA72787

SEQ ID NO: 6622 - protein, 566 aa, Artificial Sequence; identical to SEQ ID NO: 5533
  hemagglutinin__InfluenzaA__AEA73288

SEQ ID NO: 6623 - protein, 566 aa, Artificial Sequence; identical to SEQ ID NO: 5533
  hemagglutinin__InfluenzaA__AEA73299

SEQ ID NO: 6624 - protein, 566 aa, Artificial Sequence; identical to SEQ ID NO: 5533
  hemagglutinin__InfluenzaA__AEA73310

SEQ ID NO: 6625 - protein, 566 aa, Artificial Sequence
  hemagglutinin__InfluenzaA__AEA73321
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVTLENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 6626 - protein, 566 aa, Artificial Sequence; identical to SEQ ID NO: 5533
  hemagglutinin__InfluenzaA__AEA73332

SEQ ID NO: 6627 - protein, 566 aa, Artificial Sequence; identical to SEQ ID NO: 5533
  hemagglutinin__InfluenzaA__AEA73343

SEQ ID NO: 6628 - protein, 566 aa, Artificial Sequence; identical to SEQ ID NO: 5533
  hemagglutinin__InfluenzaA__AEA73354

SEQ ID NO: 6629 - protein, 566 aa, Artificial Sequence
  hemagglutinin__InfluenzaA__AEA73365
MKTIIALSYTLCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 6630 - protein, 566 aa, Artificial Sequence; identical to SEQ ID NO: 5533
  hemagglutinin__InfluenzaA__AEA73376

SEQ ID NO: 6631 - protein, 566 aa, Artificial Sequence; identical to SEQ ID NO: 5533
  hemagglutinin__InfluenzaA__AEA73387

SEQ ID NO: 6632 - protein, 566 aa, Artificial Sequence; identical to SEQ ID NO: 5533
  hemagglutinin__InfluenzaA__AEA73398

SEQ ID NO: 6633 - protein, 566 aa, Artificial Sequence; identical to SEQ ID NO: 5533
  hemagglutinin__InfluenzaA__AEA73409

SEQ ID NO: 6634 - protein, 566 aa, Artificial Sequence; identical to SEQ ID NO: 5533
  hemagglutinin__InfluenzaA__AEA73420

SEQ ID NO: 6635 - protein, 566 aa, Artificial Sequence; identical to SEQ ID NO: 5533
  hemagglutinin__InfluenzaA__AEA73452

SEQ ID NO: 6636 - protein, 566 aa, Artificial Sequence; identical to SEQ ID NO: 5533
  hemagglutinin__InfluenzaA__AEA73463

SEQ ID NO: 6637 - protein, 566 aa, Artificial Sequence; identical to SEQ ID NO: 5533
  hemagglutinin__InfluenzaA__AEA73474

SEQ ID NO: 6638 - protein, 566 aa, Artificial Sequence
  hemagglutinin__InfluenzaA__AEA73485
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 6639 - protein, 566 aa, Artificial Sequence; identical to SEQ ID NO: 5533
  hemagglutinin__InfluenzaA__AEA73496

SEQ ID NO: 6640 - protein, 566 aa, Artificial Sequence; identical to SEQ ID NO: 5533
  hemagglutinin__InfluenzaA__AEA73507

SEQ ID NO: 6641 - protein, 566 aa, Artificial Sequence; identical to SEQ ID NO: 5533
  hemagglutinin__InfluenzaA__AEA73518

SEQ ID NO: 6642 - protein, 566 aa, Artificial Sequence; identical to SEQ ID NO: 5533
  hemagglutinin__InfluenzaA__AEA73529

SEQ ID NO: 6643 - protein, 566 aa, Artificial Sequence; identical to SEQ ID NO: 5533
  hemagglutinin__InfluenzaA__AEA73540

SEQ ID NO: 6644 - protein, 566 aa, Artificial Sequence; identical to SEQ ID NO: 5533
  hemagglutinin__InfluenzaA__AEA73551

SEQ ID NO: 6645 - protein, 566 aa, Artificial Sequence; identical to SEQ ID NO: 5533
  hemagglutinin__InfluenzaA__AEA73562

SEQ ID NO: 6646 - protein, 565 aa, Artificial Sequence
  hemagglutinin__InfluenzaA__AEA73573
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTEKNGLYPNLSKSYANNKEKEVLVLWGVHHPPNIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6647 - protein, 565 aa, Artificial Sequence
  hemagglutinin__InfluenzaA__AEA73584
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRNQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6648 - protein, 565 aa, Artificial Sequence
  hemagglutinin__InfluenzaA__AEA73595
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6649 - protein, 565 aa, Artificial Sequence; identical to SEQ ID NO: 5953
  hemagglutinin__InfluenzaA__AEA73606

SEQ ID NO: 6650 - protein, 565 aa, Artificial Sequence; identical to SEQ ID NO: 3131
  hemagglutinin__InfluenzaA__AEA73617

SEQ ID NO: 6651 - protein, 565 aa, Artificial Sequence; identical to SEQ ID NO: 3616
  hemagglutinin__InfluenzaA__AEA73628

SEQ ID NO: 6652 - protein, 565 aa, Artificial Sequence; identical to SEQ ID NO: 5972
  hemagglutinin__InfluenzaA__AEA73639

SEQ ID NO: 6653 - protein, 565 aa, Artificial Sequence; identical to SEQ ID NO: 3131
  hemagglutinin__InfluenzaA__AEA73650

SEQ ID NO: 6654 - protein, 565 aa, Artificial Sequence; identical to SEQ ID NO: 3616
  hemagglutinin__InfluenzaA__AEA73661

SEQ ID NO: 6655 - protein, 565 aa, Artificial Sequence
  hemagglutinin__InfluenzaA__AEA73672
MKVKLLVLLCTFTATFADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6656 - protein, 565 aa, Artificial Sequence; identical to SEQ ID NO: 3616
  hemagglutinin__InfluenzaA__AEA73683

SEQ ID NO: 6657 - protein, 565 aa, Artificial Sequence
  hemagglutinin__InfluenzaA__AEA73694
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVELESMGVYQILAIYSTVASSLVLLVSLGAISFWMCSNGSLQCRICI

SEQ ID NO: 6658 - protein, 565 aa, Artificial Sequence; identical to SEQ ID NO: 3616
  hemagglutinin__InfluenzaA__AEA73705

SEQ ID NO: 6659 - protein, 565 aa, Artificial Sequence; identical to SEQ ID NO: 3131
  hemagglutinin__InfluenzaA__AEA73716

SEQ ID NO: 6660 - protein, 565 aa, Artificial Sequence; identical to SEQ ID NO: 3131
  hemagglutinin__InfluenzaA__AEA73727

SEQ ID NO: 6661 - protein, 565 aa, Artificial Sequence; identical to SEQ ID NO: 3131
  hemagglutinin__InfluenzaA__AEA73738

SEQ ID NO: 6662 - protein, 565 aa, Artificial Sequence; identical to SEQ ID NO: 3131
  hemagglutinin__InfluenzaA__AEA73749

SEQ ID NO: 6663 - protein, 565 aa, Artificial Sequence
  hemagglutinin__InfluenzaA__AEA73760
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTVKNGLYPNLSKSYANNKEKEVLVLWGVHHPPNIVDQKTLYRTENAYVSVVSSHYSRKFTPEIAKRPKIRDQEGRINYYWTLLEPGDTIIFEANGNLIAPRYAFALSRGFGSGIINSNAPMDKCDAKCQTPRGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6664 - protein, 566 aa, Artificial Sequence; identical to SEQ ID NO: 2669
  hemagglutinin__InfluenzaA__AEA73771

SEQ ID NO: 6665 - protein, 566 aa, Artificial Sequence; identical to SEQ ID NO: 4299
  hemagglutinin__InfluenzaA__AEA73781

SEQ ID NO: 6666 - protein, 566 aa, Artificial Sequence; identical to SEQ ID NO: 4221
  hemagglutinin__InfluenzaA__AEA73791

SEQ ID NO: 6667 - protein, 566 aa, Artificial Sequence; identical to SEQ ID NO: 2849
  hemagglutinin__InfluenzaA__AEA73801

SEQ ID NO: 6668 - protein, 566 aa, Artificial Sequence; identical to SEQ ID NO: 3833
  hemagglutinin__InfluenzaA__AEA73811

SEQ ID NO: 6669 - protein, 566 aa, Artificial Sequence; identical to SEQ ID NO: 4391
  hemagglutinin__InfluenzaA__AEA73821

SEQ ID NO: 6670 - protein, 566 aa, Artificial Sequence
  hemagglutinin__InfluenzaA__AEA73831
MKAILVVLLYTFATANADTLCIGYHANNSTDTVDTVLEKNVTVTHSVNLLEDKHNGKLCKLRGVTPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6671 - protein, 566 aa, Artificial Sequence
  hemagglutinin__InfluenzaA__AEA73841
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAESGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVVEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6672 - protein, 566 aa, Artificial Sequence; identical to SEQ ID NO: 4299
  hemagglutinin__InfluenzaA__AEA73851

SEQ ID NO: 6673 - protein, 566 aa, Artificial Sequence
  hemagglutinin__InfluenzaA__AEA73861
MKAILVVLLYTFATANADTLCIGYHANNSTDTVDTVLEKNVTVTHSVNLLEDKHNGKLCKLRGVAPLHLGECNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6674 - protein, 566 aa, Artificial Sequence; identical to SEQ ID NO: 4541
  hemagglutinin__InfluenzaA__AEA73871

SEQ ID NO: 6675 - protein, 566 aa, Artificial Sequence; identical to SEQ ID NO: 4541
  hemagglutinin__InfluenzaA__AEA73881

SEQ ID NO: 6676 - protein, 566 aa, Artificial Sequence; identical to SEQ ID NO: 4221
  hemagglutinin__InfluenzaA__AEA73891

SEQ ID NO: 6677 - protein, 566 aa, Artificial Sequence
  hemagglutinin__InfluenzaA__AEA73901
MNAILVVLLYTFATANADTLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKINSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6678 - protein, 566 aa, Artificial Sequence; identical to SEQ ID NO: 3833
  hemagglutinin__InfluenzaA__AEA73911

SEQ ID NO: 6679 - protein, 566 aa, Artificial Sequence; identical to SEQ ID NO: 4541
  hemagglutinin__InfluenzaA__AEA73921

SEQ ID NO: 6680 - protein, 566 aa, Artificial Sequence; identical to SEQ ID NO: 4299
  hemagglutinin__InfluenzaA__AEA73931

SEQ ID NO: 6681 - protein, 566 aa, Artificial Sequence; identical to SEQ ID NO: 4299
  hemagglutinin__InfluenzaA__AEA73961

SEQ ID NO: 6682 - protein, 566 aa, Artificial Sequence
  hemagglutinin__InfluenzaA__AEA73971
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHSITIGKCPKYVKSTKLRLATGLRNVPSIQSRGLFGAIAGFIEGGWTGMVDGWYGYHHQNEQGSGYAADQKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCNNTCMESVKNGTYDYPKYSEEAKLNREEIDGVKLESTRIYQILAIYSTVASSLVLVVSLGAISFWMCSNGSLQCRICI

SEQ ID NO: 6683 - protein, 566 aa, Artificial Sequence; identical to SEQ ID NO: 4299
  hemagglutinin__InfluenzaA__AEA73981

SEQ ID NO: 6684 - protein, 566 aa, Artificial Sequence
  hemagglutinin__InfluenzaA__AEA73991
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGAKSFYKNLIWLVKKGNSYPKLSKSYINDKGKEVLVLWGIHHPSTSADQQSLYQNADSYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6685 - protein, 566 aa, Artificial Sequence; identical to SEQ ID NO: 4282
  hemagglutinin__InfluenzaA__AEA74001

SEQ ID NO: 6686 - protein, 566 aa, Artificial Sequence
  hemagglutinin__InfluenzaA__AEA74011
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKRNSYPKLSQSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESIKNGTYDYPKYSEEAKLNREEIDGVKLESTRIYQILAIYSTVASSLVLVVSLGAISFWMCSNGSLQCRICI

SEQ ID NO: 6687 - protein, 566 aa, Artificial Sequence
  hemagglutinin__InfluenzaA__AEA74021
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSQSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESIKNGTYDYPKYSEEAKLNREEIDGVKLESTRIYQILAIYSTVASSLVLVVSLGAISFWMCSNGSLQCRICI

SEQ ID NO: 6688 - protein, 566 aa, Artificial Sequence
  hemagglutinin__InfluenzaA__AEA74031
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYNNLIWLVKKGNSYPKLNKSYINDKGKEVLVLWGIHHPSTSTDQQSLYQNADAYVFVGTSRYSKKFKPEIAIRPKVRNQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6689 - protein, 566 aa, Artificial Sequence
  hemagglutinin__InfluenzaA__AEA74035
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYNNLIWLVKKGNSYPKLNKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6690 - protein, 566 aa, Artificial Sequence; identical to SEQ ID NO: 2434
  hemagglutinin__InfluenzaA__AEA77299

SEQ ID NO: 6691 - protein, 566 aa, Artificial Sequence; identical to SEQ ID NO: 6435
  hemagglutinin__InfluenzaA__AEB21316

SEQ ID NO: 6692 - protein, 566 aa, Artificial Sequence; identical to SEQ ID NO: 6454
  hemagglutinin__InfluenzaA__AEB21326

SEQ ID NO: 6693 - protein, 566 aa, Artificial Sequence; identical to SEQ ID NO: 6435
  hemagglutinin__InfluenzaA__AEB21338

SEQ ID NO: 6694 - protein, 566 aa, Artificial Sequence; identical to SEQ ID NO: 6454
  hemagglutinin__InfluenzaA__AEB21348

SEQ ID NO: 6695 - protein, 566 aa, Artificial Sequence; identical to SEQ ID NO: 3588
  hemagglutinin__InfluenzaA__AEB40206

SEQ ID NO: 6696 - protein, 566 aa, Artificial Sequence; identical to SEQ ID NO: 3588
  hemagglutinin__InfluenzaA__AEB66895

SEQ ID NO: 6697 - protein, 565 aa, Artificial Sequence
  hemagglutinin__InfluenzaA__AEB71102
MDVPVFVLLMLTSICVQADRICVGYLSTNSSERVDTLLENNVPVTSSVDLVETNHTGTYCSLGGISPVHLGDCSFEGWIVGNPACASNLGIREWSYLIEDPSAPHGLCYPGELDNNGELRHLFSGIRSFSRTELIAPTSWGEVNDGVTAACQDKGASSFYRNLVWFVERGNKYPVIRRTYNNTTGRDVLVIWGIHHPVSTDEARKLYAKDNPYTLVSTSSWSRKYNLETGTRPGYNGQKSWTKIYWYLMHPGDSISFESNGGLLAPKYGYIIEEYGKGRIFQSRIRIAKCNTKCQTSVGGINTNKTFQNIERNALGDCPKYIKSGQLKLATGLRNVPAISNRGLFGAIAGFIEGGWPGLINGWYGFQHQNEQGMGMAADKESTQKAIDQITTKINNIIEKMNGNYDSIRGEFSQVEQRINMLADRIDDAVTDVWSYNAKLLVLLENDKTLDMHDANVRNLHDQVRRVLRTNAIDEGNGCFELLHKCNDSCMETIRNGTYNHIEYEEESKLKRQEIEGIKLKSDDNVYKALSIYSCIASSIVLVGLILAFIMWACSSGNCRFNICI

SEQ ID NO: 6698 - protein, 565 aa, Artificial Sequence
  hemagglutinin__InfluenzaA__AEB71896
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNKEKIDGVKLESMGVYQILAIYSTVASSLVLLVSLGAISFWMCSNGSLQCRICI

SEQ ID NO: 6699 - protein, 566 aa, Artificial Sequence; identical to SEQ ID NO: 2911
  hemagglutinin__InfluenzaA__AEB71916

SEQ ID NO: 6700 - protein, 566 aa, Artificial Sequence; identical to SEQ ID NO: 2434
  hemagglutinin__InfluenzaA__AEB71925

SEQ ID NO: 6701 - protein, 566 aa, Artificial Sequence; identical to SEQ ID NO: 2434
  hemagglutinin__InfluenzaA__AEB71936

SEQ ID NO: 6702 - protein, 566 aa, Artificial Sequence; identical to SEQ ID NO: 2434
  hemagglutinin__InfluenzaA__AEB71947

SEQ ID NO: 6703 - protein, 565 aa, Artificial Sequence; identical to SEQ ID NO: 5972
  hemagglutinin__InfluenzaA__AEB71958

SEQ ID NO: 6704 - protein, 566 aa, Artificial Sequence; identical to SEQ ID NO: 5419
  hemagglutinin__InfluenzaA__AEB71969

SEQ ID NO: 6705 - protein, 566 aa, Artificial Sequence
  hemagglutinin__InfluenzaA__AEB71980
MKTIIALSCILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6706 - protein, 565 aa, Artificial Sequence; identical to SEQ ID NO: 3616
  hemagglutinin__InfluenzaA__AEB71992

SEQ ID NO: 6707 - protein, 565 aa, Artificial Sequence; identical to SEQ ID NO: 3616
  hemagglutinin__InfluenzaA__AEC13313

SEQ ID NO: 6708 - protein, 566 aa, Artificial Sequence
  hemagglutinin__InfluenzaA__AEC46553
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSTSYINDKGKEVLVLWGIHHPSTSADQQSLYQNADAYAFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAFDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6709 - protein, 566 aa, Artificial Sequence
  hemagglutinin__InfluenzaA__AEC46555
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSTSYINDKGKKVLVLWGIHHPSTSADQQSLYQNADAYAFVGTSRYSKKFKPEIAIRPKVRDQEGRMNYYWTLVEPGDKITFEATGNLVVPRYAFAMERNEGSGIIISDTSVHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAFDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6710 - protein, 566 aa, Artificial Sequence; identical to SEQ ID NO: 6708
  hemagglutinin__InfluenzaA__AEC46557

SEQ ID NO: 6711 - protein, 566 aa, Artificial Sequence; identical to SEQ ID NO: 2656
  hemagglutinin__InfluenzaA__AEC53259

SEQ ID NO: 6712 - protein, 566 aa, Artificial Sequence
  hemagglutinin__InfluenzaA__AEC53269
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELRELLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6713 - protein, 566 aa, Artificial Sequence; identical to SEQ ID NO: 3399
  hemagglutinin__InfluenzaA__AEC53279

SEQ ID NO: 6714 - protein, 566 aa, Artificial Sequence; identical to SEQ ID NO: 2656
  hemagglutinin__InfluenzaA__AEC53289

SEQ ID NO: 6715 - protein, 566 aa, Artificial Sequence; identical to SEQ ID NO: 2656
  hemagglutinin__InfluenzaA__AEC53299

SEQ ID NO: 6716 - protein, 566 aa, Artificial Sequence; identical to SEQ ID NO: 2849
  hemagglutinin__InfluenzaA__AEC53327

SEQ ID NO: 6717 - protein, 566 aa, Artificial Sequence
  hemagglutinin__InfluenzaA__AEC53347
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLIEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6718 - protein, 566 aa, Artificial Sequence
  hemagglutinin__InfluenzaA__AEC53404
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGITAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6719 - protein, 566 aa, Artificial Sequence; identical to SEQ ID NO: 2656
  hemagglutinin__InfluenzaA__AEC53414

SEQ ID NO: 6720 - protein, 566 aa, Artificial Sequence
  hemagglutinin__InfluenzaA__AEE27177
MKTILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKRKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6721 - protein, 566 aa, Artificial Sequence; identical to SEQ ID NO: 4441
  hemagglutinin__InfluenzaA__AEE27187

SEQ ID NO: 6722 - protein, 566 aa, Artificial Sequence
  hemagglutinin__InfluenzaA__AEE27207
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSKVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6723 - protein, 566 aa, Artificial Sequence
  hemagglutinin__InfluenzaA__AEG64752
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVRSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRRQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6724 - protein, 566 aa, Artificial Sequence
  hemagglutinin__InfluenzaA__AEG64762
MKARLLVLLCALAATDADTICIGYHANNSTDTVDTLLEKNVTVTHSVNLLEDSHNGKLCKLKGIAPLQLGKCNIAGWLLGNPECDSLLPARSWSYIVETPNSENGACYPGDFIDYEELREQLSTVSSLERFEIFPKESSWPNHNTLKGVTVSCSHGGKSSFYRNLLWLTKTGDSYPKLNNSYVNNKGKEVLVLWGVHHPSSSNEQQSLYHNVNAYVSVVSSNYNRRFTPEIAARPKVRDQPGRMNYYWTLLEPGDTILFEATGNLIAPWYAFALSRGFGSGIITSNASMHECNTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNNLEKRMENLNKKVDDGFLDIWTYNAELLVLLENERTLDFHDLNVKNLYEKVKSQLKNNAKEIGNGCFEFYHKCDNECMESVRDGTYDYPKYSEESKLNREKIDGVKLESMGVYQILAIYSTVASSLVLLVSLGAISFWMCSNGSLQCRICI

SEQ ID NO: 6725 - protein, 566 aa, Artificial Sequence; identical to SEQ ID NO: 2669
  hemagglutinin__InfluenzaA__AEG64784

SEQ ID NO: 6726 - protein, 566 aa, Artificial Sequence
  hemagglutinin__InfluenzaA__AEG64834
MKTIIALSYILCLVFAQKLPGNDNSTATLCLGHHAVPNGTIVKTITNDQIEVTNATELVQNSSAGEICDSPHQILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6727 - protein, 566 aa, Artificial Sequence
  hemagglutinin__InfluenzaA__AEG64845
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6728 - protein, 566 aa, Artificial Sequence
  hemagglutinin__InfluenzaA__AEG64856
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSVMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVVLLGFIMWACQKGNIRCNICI

SEQ ID NO: 6729 - protein, 566 aa, Artificial Sequence; identical to SEQ ID NO: 72
  hemagglutinin__InfluenzaA__AEG64867

SEQ ID NO: 6730 - protein, 566 aa, Artificial Sequence
  hemagglutinin__InfluenzaA__AEG64878
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 6731 - protein, 566 aa, Artificial Sequence
  hemagglutinin__InfluenzaA__AEG64889
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLFASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 6732 - protein, 566 aa, Artificial Sequence; identical to SEQ ID NO: 32
  hemagglutinin__InfluenzaA__AEG64911

SEQ ID NO: 6733 - protein, 566 aa, Artificial Sequence; identical to SEQ ID NO: 32
  hemagglutinin__InfluenzaA__AEG64922

SEQ ID NO: 6734 - protein, 566 aa, Artificial Sequence; identical to SEQ ID NO: 32
  hemagglutinin__InfluenzaA__AEG64933

SEQ ID NO: 6735 - protein, 566 aa, Artificial Sequence; identical to SEQ ID NO: 118
  hemagglutinin__InfluenzaA__AEG64944

SEQ ID NO: 6736 - protein, 566 aa, Artificial Sequence; identical to SEQ ID NO: 32
  hemagglutinin__InfluenzaA__AEG64955

SEQ ID NO: 6737 - protein, 566 aa, Artificial Sequence; identical to SEQ ID NO: 32
  hemagglutinin__InfluenzaA__AEG64966

SEQ ID NO: 6738 - protein, 566 aa, Artificial Sequence
  hemagglutinin__InfluenzaA__AEG64977
MKTIIALSYILCLVFAQKLPENDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6739 - protein, 566 aa, Artificial Sequence
  hemagglutinin__InfluenzaA__AEG64988
MKTIIALSYILCLVFAQKLPGNDNSTATLCLGHHAVPNGTIVKTITNDQIEVTNATELVQSSSTGEICDMPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 6740 - protein, 566 aa, Artificial Sequence
  hemagglutinin__InfluenzaA__AEG64999
MKTIIALSYILCLVFAQKLPGNDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYVSLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6741 - protein, 566 aa, Artificial Sequence; identical to SEQ ID NO: 255
  hemagglutinin__InfluenzaA__AEG65010

SEQ ID NO: 6742 - protein, 566 aa, Artificial Sequence
  hemagglutinin__InfluenzaA__AEG65021
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYVSLRSLVASSGTLEFNNESFNWTGVTQNGTSSACKRRSNNSFFSRLNWLTHLKFKYPALNVTMPNTEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6743 - protein, 566 aa, Artificial Sequence
  hemagglutinin__InfluenzaA__AEG65032
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNKLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6744 - protein, 566 aa, Artificial Sequence; identical to SEQ ID NO: 630
  hemagglutinin__InfluenzaA__AEG65043

SEQ ID NO: 6745 - protein, 566 aa, Artificial Sequence; identical to SEQ ID NO: 630
  hemagglutinin__InfluenzaA__AEG65054

SEQ ID NO: 6746 - protein, 566 aa, Artificial Sequence
  hemagglutinin__InfluenzaA__AEG65065
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCVVLLGFIMWACQKGNIRCNICI

SEQ ID NO: 6747 - protein, 566 aa, Artificial Sequence
  hemagglutinin__InfluenzaA__AEG65076
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLRFKYPALNVTMPNNEKFDKLYIWGVHHPGTDNDQIFLYAQASGRITVSTKRSQQTVIPNVGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6748 - protein, 566 aa, Artificial Sequence
  hemagglutinin__InfluenzaA__AEG65087
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6749 - protein, 566 aa, Artificial Sequence
  hemagglutinin__InfluenzaA__AEG65098
MKTIIALSYILCLVFAQKLPGNDNSTATLCLGHHAVPNGTIVKTITNDQIEVTNATELVQSSSTGEICDSPHQILDGENCTLIDALLGDPQCDDFQNKKWDLFVERSKAYSNCYPYDVPDYASLRSLVASSGTLEFNNESFNWTGVTQNGTSSACKRRSNNSFFSRLNWLTHSKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGNLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 6750 - protein, 566 aa, Artificial Sequence
  hemagglutinin__InfluenzaA__AEG65109
MKTIIALSYILCLVFAQKLPGNDNSTATLCLGHHAVPNGTIVKTITNDQIEVTNATELVQSSSTGEICDSPHQILDGENCKLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQSSGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6751 - protein, 566 aa, Artificial Sequence
  hemagglutinin__InfluenzaA__AEG65120
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRIAYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 6752 - protein, 566 aa, Artificial Sequence
  hemagglutinin__InfluenzaA__AEG65131
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHSKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 6753 - protein, 566 aa, Artificial Sequence; identical to SEQ ID NO: 51
  hemagglutinin__InfluenzaA__AEG65142

SEQ ID NO: 6754 - protein, 566 aa, Artificial Sequence; identical to SEQ ID NO: 51
  hemagglutinin__InfluenzaA__AEG65153

SEQ ID NO: 6755 - protein, 566 aa, Artificial Sequence
  hemagglutinin__InfluenzaA__AEG65164
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAEFLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 6756 - protein, 566 aa, Artificial Sequence
  hemagglutinin__InfluenzaA__AEG65175
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRNGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 6757 - protein, 566 aa, Artificial Sequence; identical to SEQ ID NO: 419
  hemagglutinin__InfluenzaA__AEG65186

SEQ ID NO: 6758 - protein, 566 aa, Artificial Sequence
  hemagglutinin__InfluenzaA__AEG65197
MKTIIALSYILCLVFAQKLPGNDNSTATLCLGHHAVPNGTIVKTITNDQIEVTNATELVQSSPTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDIILINSTGNLIAPRGYFKIRSGKSSIMRSDTPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6759 - protein, 566 aa, Artificial Sequence; identical to SEQ ID NO: 630
  hemagglutinin__InfluenzaA__AEG65208

SEQ ID NO: 6760 - protein, 566 aa, Artificial Sequence
  hemagglutinin__InfluenzaA__AEG65219
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIKCNICI

SEQ ID NO: 6761 - protein, 566 aa, Artificial Sequence; identical to SEQ ID NO: 1795
  hemagglutinin__InfluenzaA__AEG65230

SEQ ID NO: 6762 - protein, 566 aa, Artificial Sequence; identical to SEQ ID NO: 1795
  hemagglutinin__InfluenzaA__AEG65252

SEQ ID NO: 6763 - protein, 566 aa, Artificial Sequence; identical to SEQ ID NO: 516
  hemagglutinin__InfluenzaA__AEG65263

SEQ ID NO: 6764 - protein, 566 aa, Artificial Sequence; identical to SEQ ID NO: 516
  hemagglutinin__InfluenzaA__AEG65274

SEQ ID NO: 6765 - protein, 566 aa, Artificial Sequence; identical to SEQ ID NO: 516
  hemagglutinin__InfluenzaA__AEG65285

SEQ ID NO: 6766 - protein, 566 aa, Artificial Sequence
  hemagglutinin__InfluenzaA__AEG65296
MKTVIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6767 - protein, 566 aa, Artificial Sequence; identical to SEQ ID NO: 1795
  hemagglutinin__InfluenzaA__AEG65307

SEQ ID NO: 6768 - protein, 566 aa, Artificial Sequence
  hemagglutinin__InfluenzaA__AEG65318
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSECITPNGSIPNDKPFQNVNRITYGACPRYVRQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6769 - protein, 566 aa, Artificial Sequence; identical to SEQ ID NO: 1795
  hemagglutinin__InfluenzaA__AEG65329

SEQ ID NO: 6770 - protein, 566 aa, Artificial Sequence
  hemagglutinin__InfluenzaA__AEG65340
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 6771 - protein, 566 aa, Artificial Sequence; identical to SEQ ID NO: 1795
  hemagglutinin__InfluenzaA__AEG65351

SEQ ID NO: 6772 - protein, 566 aa, Artificial Sequence; identical to SEQ ID NO: 1795
  hemagglutinin__InfluenzaA__AEG65362

SEQ ID NO: 6773 - protein, 566 aa, Artificial Sequence; identical to SEQ ID NO: 6770
  hemagglutinin__InfluenzaA__AEG65373

SEQ ID NO: 6774 - protein, 566 aa, Artificial Sequence; identical to SEQ ID NO: 516
  hemagglutinin__InfluenzaA__AEG65384

SEQ ID NO: 6775 - protein, 566 aa, Artificial Sequence; identical to SEQ ID NO: 516
  hemagglutinin__InfluenzaA__AEG65406

SEQ ID NO: 6776 - protein, 566 aa, Artificial Sequence; identical to SEQ ID NO: 516
  hemagglutinin__InfluenzaA__AEG65417

SEQ ID NO: 6777 - protein, 566 aa, Artificial Sequence; identical to SEQ ID NO: 516
  hemagglutinin__InfluenzaA__AEG65428

SEQ ID NO: 6778 - protein, 566 aa, Artificial Sequence
  hemagglutinin__InfluenzaA__AEG65439
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGVGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6779 - protein, 566 aa, Artificial Sequence
  hemagglutinin__InfluenzaA__AEG65450
MKTIIAWSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6780 - protein, 566 aa, Artificial Sequence; identical to SEQ ID NO: 6779
  hemagglutinin__InfluenzaA__AEG65461

SEQ ID NO: 6781 - protein, 566 aa, Artificial Sequence
  hemagglutinin__InfluenzaA__AEG65472
MKTIIAWSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEITKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6782 - protein, 566 aa, Artificial Sequence; identical to SEQ ID NO: 6779
  hemagglutinin__InfluenzaA__AEG65483

SEQ ID NO: 6783 - protein, 566 aa, Artificial Sequence; identical to SEQ ID NO: 6779
  hemagglutinin__InfluenzaA__AEG65494

SEQ ID NO: 6784 - protein, 566 aa, Artificial Sequence; identical to SEQ ID NO: 6779
  hemagglutinin__InfluenzaA__AEG65505

SEQ ID NO: 6785 - protein, 566 aa, Artificial Sequence; identical to SEQ ID NO: 6779
  hemagglutinin__InfluenzaA__AEG65516

SEQ ID NO: 6786 - protein, 566 aa, Artificial Sequence; identical to SEQ ID NO: 6779
  hemagglutinin__InfluenzaA__AEG65527

SEQ ID NO: 6787 - protein, 566 aa, Artificial Sequence; identical to SEQ ID NO: 6779
  hemagglutinin__InfluenzaA__AEG65538

SEQ ID NO: 6788 - protein, 566 aa, Artificial Sequence
  hemagglutinin__InfluenzaA__AEG65560
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6789 - protein, 566 aa, Artificial Sequence; identical to SEQ ID NO: 6788
  hemagglutinin__InfluenzaA__AEG65571

SEQ ID NO: 6790 - protein, 566 aa, Artificial Sequence; identical to SEQ ID NO: 6788
  hemagglutinin__InfluenzaA__AEG65582

SEQ ID NO: 6791 - protein, 566 aa, Artificial Sequence; identical to SEQ ID NO: 6788
  hemagglutinin__InfluenzaA__AEG65593

SEQ ID NO: 6792 - protein, 566 aa, Artificial Sequence
  hemagglutinin__InfluenzaA__AEG65604
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNNSFFSRLNWLTHLKFKYPALNVTMPNNEEFDKLYIWGVHHPGTDNDQISLYAQASGKITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6793 - protein, 566 aa, Artificial Sequence
  hemagglutinin__InfluenzaA__AEG65626
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNNSFFSRLNWLTHLKFKYPALNVTMPNNKKFDKLYIWGVHHPGTDNDQISLYAQASGRITVSTKRSQQTVIPNIGSRPRVRDIPSRISIYWTIVKPGDMLLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6794 - protein, 566 aa, Artificial Sequence
  hemagglutinin__InfluenzaA__AEG65637
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNNSFFSRLNWLTHLKFKYPALNVTMPNNKKFDKLYIWGVHHPGTDNDQISLYAQASGRITVSTKRSQQTVIPNIGSRPRVRDIPSRISIYWTIVKPGDMLLINSTGNLIAPRGYFKIRSGRSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6795 - protein, 566 aa, Artificial Sequence; identical to SEQ ID NO: 31
  hemagglutinin__InfluenzaA__AEG65648

SEQ ID NO: 6796 - protein, 566 aa, Artificial Sequence; identical to SEQ ID NO: 1795
  hemagglutinin__InfluenzaA__AEG65659

SEQ ID NO: 6797 - protein, 566 aa, Artificial Sequence; identical to SEQ ID NO: 1795
  hemagglutinin__InfluenzaA__AEG65670

SEQ ID NO: 6798 - protein, 566 aa, Artificial Sequence; identical to SEQ ID NO: 1795
  hemagglutinin__InfluenzaA__AEG65681

SEQ ID NO: 6799 - protein, 566 aa, Artificial Sequence; identical to SEQ ID NO: 6770
  hemagglutinin__InfluenzaA__AEG65692

SEQ ID NO: 6800 - protein, 566 aa, Artificial Sequence; identical to SEQ ID NO: 630
  hemagglutinin__InfluenzaA__AEG65703

SEQ ID NO: 6801 - protein, 566 aa, Artificial Sequence
  hemagglutinin__InfluenzaA__AEG65747
MKTIIALSYILCLVFAQKLPGNDNSTATLCLGHHTVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6802 - protein, 566 aa, Artificial Sequence
  hemagglutinin__InfluenzaA__AEG65758
MKTIIALSYILCLVSAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6803 - protein, 566 aa, Artificial Sequence; identical to SEQ ID NO: 281
  hemagglutinin__InfluenzaA__AEG65769

SEQ ID NO: 6804 - protein, 566 aa, Artificial Sequence
  hemagglutinin__InfluenzaA__AEG65780
MKTIIALSYILCLVFAQKLPGNDNSTATLCLGHHAVPNGTIVKTITNDKIEVTNATELVQSSSTGEICNSPHQILDGENCTLIDALLGDPQCDGFQNKKWDLFVERSKAHSNCYPYDVPDYASLRSLVAASGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6805 - protein, 566 aa, Artificial Sequence
  hemagglutinin__InfluenzaA__AEG65813
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKTDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6806 - protein, 566 aa, Artificial Sequence
  hemagglutinin__InfluenzaA__AEG79801
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6807 - protein, 566 aa, Artificial Sequence
  hemagglutinin__InfluenzaA__AEG79807
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKENSYPKLSKSYINDKGKEVLVLWGIHHPSTTADQQSIYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6808 - protein, 566 aa, Artificial Sequence
  hemagglutinin__InfluenzaA__AEG79835
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSIYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6809 - protein, 566 aa, Artificial Sequence
  hemagglutinin__InfluenzaA__AEH59363
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6810 - protein, 566 aa, Artificial Sequence
  hemagglutinin__InfluenzaA__AEH59367
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWALVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6811 - protein, 566 aa, Artificial Sequence
  hemagglutinin__InfluenzaA__AEH59369
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKASSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6812 - protein, 566 aa, Artificial Sequence; identical to SEQ ID NO: 6809
  hemagglutinin__InfluenzaA__AEH59371

SEQ ID NO: 6813 - protein, 566 aa, Artificial Sequence
  hemagglutinin__InfluenzaA__AEH59373
MKAILVVLLYTFATANADTLCIGYHANNSTDTVDTVLEKNVTVTHSVNLLEDKHNGKLCKLREVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYRHQNEQGSGYAADLKSTQNAIDKITNKVNSVIEKMNTQFTAVGKEFNHLERRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6814 - protein, 566 aa, Artificial Sequence; identical to SEQ ID NO: 6809
  hemagglutinin__InfluenzaA__AEH59375

SEQ ID NO: 6815 - protein, 566 aa, Artificial Sequence
  hemagglutinin__InfluenzaA__AEH59379
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKETGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6816 - protein, 566 aa, Artificial Sequence; identical to SEQ ID NO: 6809
  hemagglutinin__InfluenzaA__AEH59381

SEQ ID NO: 6817 - protein, 566 aa, Artificial Sequence
  hemagglutinin__InfluenzaA__AEH59383
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSISYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6818 - protein, 566 aa, Artificial Sequence
  hemagglutinin__InfluenzaA__AEH59385
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYIFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6819 - protein, 566 aa, Artificial Sequence; identical to SEQ ID NO: 6809
  hemagglutinin__InfluenzaA__AEH59387

SEQ ID NO: 6820 - protein, 566 aa, Artificial Sequence
  hemagglutinin__InfluenzaA__AEH59393
MKAILVVILYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6821 - protein, 566 aa, Artificial Sequence
  hemagglutinin__InfluenzaA__AEH59397
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPSHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIENGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6822 - protein, 566 aa, Artificial Sequence
  hemagglutinin__InfluenzaA__AEH59399
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTIVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6823 - protein, 566 aa, Artificial Sequence
  hemagglutinin__InfluenzaA__AEH59403
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVAPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6824 - protein, 566 aa, Artificial Sequence
  hemagglutinin__InfluenzaA__AEH59407
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6825 - protein, 566 aa, Artificial Sequence; identical to SEQ ID NO: 6824
  hemagglutinin__InfluenzaA__AEH59409

SEQ ID NO: 6826 - protein, 566 aa, Artificial Sequence
  hemagglutinin__InfluenzaA__AEH59411
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMDRNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6827 - protein, 566 aa, Artificial Sequence
  hemagglutinin__InfluenzaA__AEH59413
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6828 - protein, 566 aa, Artificial Sequence
  hemagglutinin__InfluenzaA__AEH59585
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTVVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6829 - protein, 566 aa, Artificial Sequence
  hemagglutinin__InfluenzaA__AEH59587
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHESNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPFIQSRGLFGAIAGFIEGGWTGMVDGWYGYHHQNEQGSGYAADLKSTQNAIDKITNKVNSVIEKMNTQFTVVGKEFNPLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6830 - protein, 566 aa, Artificial Sequence; identical to SEQ ID NO: 3833
  hemagglutinin__InfluenzaA__AEH59589

SEQ ID NO: 6831 - protein, 566 aa, Artificial Sequence
  hemagglutinin__InfluenzaA__AEH59591
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTVVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6832 - protein, 566 aa, Artificial Sequence
  hemagglutinin__InfluenzaA__AEH59593
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHESNKGVTAACPHAGAKSFYKNLIWLVKKGNSYPKLSKSYINDKGKEVLVLWGIHHPSTSADQQSIYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6833 - protein, 566 aa, Artificial Sequence; identical to SEQ ID NO: 3467
  hemagglutinin__InfluenzaA__AEH59595

SEQ ID NO: 6834 - protein, 566 aa, Artificial Sequence; identical to SEQ ID NO: 3833
  hemagglutinin__InfluenzaA__AEH59597

SEQ ID NO: 6835 - protein, 566 aa, Artificial Sequence; identical to SEQ ID NO: 6828
  hemagglutinin__InfluenzaA__AEH59599

SEQ ID NO: 6836 - protein, 566 aa, Artificial Sequence
  hemagglutinin__InfluenzaA__AEH59601
MKAILVVLLYTFATANADTLCIGYHANNSTDTVDTVLEKNVTVTHSVNLLEDKHNGKLCKLRGVAPLHLGNCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTVVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6837 - protein, 566 aa, Artificial Sequence; identical to SEQ ID NO: 3467
  hemagglutinin__InfluenzaA__AEH59604

SEQ ID NO: 6838 - protein, 566 aa, Artificial Sequence; identical to SEQ ID NO: 3467
  hemagglutinin__InfluenzaA__AEH59614

SEQ ID NO: 6839 - protein, 566 aa, Artificial Sequence
  hemagglutinin__InfluenzaA__AEH59624
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSFYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6840 - protein, 565 aa, Artificial Sequence
  hemagglutinin__InfluenzaA__AEH77259
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEMFPKESSWPNHTVTGVSASCSHNGESSFYRNLLWLTEKNGLYPNLSKSYANNKEKEVLVLWGVHHPPSISDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKNQLKNNAKEIGNGCFEFYHKCNDECMESVKNGTYDYPKYSEESKLNREKIDGVKLESMGVYQILAIYSTVASSLVFLVSLGAISFWMCSNGSLQCRICI

SEQ ID NO: 6841 - protein, 566 aa, Artificial Sequence; identical to SEQ ID NO: 2656
  hemagglutinin__InfluenzaA__AEH77270

SEQ ID NO: 6842 - protein, 566 aa, Artificial Sequence; identical to SEQ ID NO: 32
  hemagglutinin__InfluenzaA__AEH77279

SEQ ID NO: 6843 - protein, 566 aa, Artificial Sequence; identical to SEQ ID NO: 3771
  hemagglutinin__InfluenzaA__AEI29215

SEQ ID NO: 6844 - protein, 566 aa, Artificial Sequence; identical to SEQ ID NO: 2669
  hemagglutinin__InfluenzaA__AEI29225

SEQ ID NO: 6845 - protein, 566 aa, Artificial Sequence
  hemagglutinin__InfluenzaA__AEI29591
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTNLYVQASGKVTVSTKRSQQTVIPNVGSRPWVRGLSSRVSIYWTIVKPGDILVINSNGNLIAPRGYYKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 6846 - protein, 566 aa, Artificial Sequence; identical to SEQ ID NO: 32
  hemagglutinin__InfluenzaA__AEI54347

SEQ ID NO: 6847 - protein, 566 aa, Artificial Sequence; identical to SEQ ID NO: 118
  hemagglutinin__InfluenzaA__AEI54358

SEQ ID NO: 6848 - protein, 566 aa, Artificial Sequence; identical to SEQ ID NO: 633
  hemagglutinin__InfluenzaA__AEI54369

SEQ ID NO: 6849 - protein, 566 aa, Artificial Sequence; identical to SEQ ID NO: 516
  hemagglutinin__InfluenzaA__AEI54380

SEQ ID NO: 6850 - protein, 566 aa, Artificial Sequence; identical to SEQ ID NO: 6779
  hemagglutinin__InfluenzaA__AEI54391

SEQ ID NO: 6851 - protein, 566 aa, Artificial Sequence
  hemagglutinin__InfluenzaA__AEI54402
MKTIIALSYILCLVFAQKLPGNDNSTATLCLGHHAVPNGTIVKTITNDQIEVTNATELVQSSSTGEICYSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6852 - protein, 566 aa, Artificial Sequence; identical to SEQ ID NO: 1928
  hemagglutinin__InfluenzaA__AEI54413

SEQ ID NO: 6853 - protein, 566 aa, Artificial Sequence; identical to SEQ ID NO: 281
  hemagglutinin__InfluenzaA__AEI54424

SEQ ID NO: 6854 - protein, 566 aa, Artificial Sequence
  hemagglutinin__InfluenzaA__AEI54446
MKTIIALSYILCLVFAQKLPENDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6855 - protein, 566 aa, Artificial Sequence
  hemagglutinin__InfluenzaA__AEI54457
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6856 - protein, 566 aa, Artificial Sequence; identical to SEQ ID NO: 5533
  hemagglutinin__InfluenzaA__AEI54468

SEQ ID NO: 6857 - protein, 566 aa, Artificial Sequence; identical to SEQ ID NO: 5533
  hemagglutinin__InfluenzaA__AEI54479

SEQ ID NO: 6858 - protein, 566 aa, Artificial Sequence; identical to SEQ ID NO: 6855
  hemagglutinin__InfluenzaA__AEI54490

SEQ ID NO: 6859 - protein, 566 aa, Artificial Sequence; identical to SEQ ID NO: 6854
  hemagglutinin__InfluenzaA__AEI54501

SEQ ID NO: 6860 - protein, 566 aa, Artificial Sequence
  hemagglutinin__InfluenzaA__AEI59979
MKTIIALSYILCLVFAQKLPGNDNSTATLCLGHHAVPNGTIVKTITNDQIEVTNATELVQISSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIEKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6861 - protein, 565 aa, Artificial Sequence; identical to SEQ ID NO: 5957
  hemagglutinin__InfluenzaA__AEI59990

SEQ ID NO: 6862 - protein, 565 aa, Artificial Sequence; identical to SEQ ID NO: 5959
  hemagglutinin__InfluenzaA__AEI60001

SEQ ID NO: 6863 - protein, 566 aa, Artificial Sequence
  hemagglutinin__InfluenzaA__AEI60012
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRSSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGKIQDLEKYVEDTKIDLWSYNAELLVALENQHTIDLTDSEMNKLFEKTKKQLRENAEDMGNGCFKIYHKCDNACIGSIRNGTYNHDVYRDEALNNRFQIKGVELKSGYKDWILWISFAISCFLLCVALLGFIMWACQKGNIRCNICI

SEQ ID NO: 6864 - protein, 566 aa, Artificial Sequence; identical to SEQ ID NO: 2434
  hemagglutinin__InfluenzaA__AEI60023

SEQ ID NO: 6865 - protein, 566 aa, Artificial Sequence
  hemagglutinin__InfluenzaA__AEI60034
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6866 - protein, 566 aa, Artificial Sequence
  hemagglutinin__InfluenzaA__AEI60045
MKTIIALSYILCLVFAQKLPGNDNSTATLCLGHHAVPNGTIVKTIMNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGYRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6867 - protein, 566 aa, Artificial Sequence
  hemagglutinin__InfluenzaA__AEI60086
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6868 - protein, 566 aa, Artificial Sequence
  hemagglutinin__InfluenzaA__AEI60109
MKTTIALSYILCLVFAQKLPGNDNSTATLCLGHHAVPNGTLVKTITNDQIEVTNATELVQNSSTGRICDSPHQILDGENCTLIDALLGDPHCDGFQNKEWDLFVERSKAYSNCYPYNVPDYVSLRSLVASSGTLEFNNESFNWTGVAQDGSSYACKRRSNKSFFSRLNWLHQLNYKYPALNVTMPNNENFDKLYIWGVHHPGTDSDQISLYAQASGRVTVSTKRSQQTVIPNIGYRPWVRGVSSIISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMKDGWYGFRHQNSEGTGQAADIKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNTCIGSIRNGTYDHDVYRDEALNNRFHIKGVELKSGYKDWILWISFATSCFLLCIVLLGFIMWACQKGNIRCNICI

SEQ ID NO: 6869 - protein, 566 aa, Artificial Sequence
  hemagglutinin__InfluenzaA__AEI86734
MKAILVVLLYTFATANADTLCVGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYRNLIWLVKKGNSYPKLSKSYINDKGKEVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6870 - protein, 566 aa, Artificial Sequence
  hemagglutinin__InfluenzaA__AEI86764
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 6871 - protein, 566 aa, Artificial Sequence; identical to SEQ ID NO: 6870
  hemagglutinin__InfluenzaA__AEI86774

SEQ ID NO: 6872 - protein, 566 aa, Artificial Sequence
  hemagglutinin__InfluenzaA__AEI86784
MKVILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFKRFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6873 - protein, 566 aa, Artificial Sequence
  hemagglutinin__InfluenzaA__AEI86794
MKTILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6874 - protein, 566 aa, Artificial Sequence
  hemagglutinin__InfluenzaA__AEI86804
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPDHDSNKGVTAACPHAGAKSFYKNLMWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSAVASSLVLVVSLGAISFWMCSNGSLQCRICI

SEQ ID NO: 6875 - protein, 566 aa, Artificial Sequence; identical to SEQ ID NO: 6870
  hemagglutinin__InfluenzaA__AEI86814

SEQ ID NO: 6876 - protein, 566 aa, Artificial Sequence
  hemagglutinin__InfluenzaA__AEI86824
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQDAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 6877 - protein, 566 aa, Artificial Sequence
  hemagglutinin__InfluenzaA__AEI86834
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSRKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6878 - protein, 566 aa, Artificial Sequence; identical to SEQ ID NO: 5584
  hemagglutinin__InfluenzaA__AEI86854

SEQ ID NO: 6879 - protein, 566 aa, Artificial Sequence
  hemagglutinin__InfluenzaA__AEI86864
MKAILVALLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6880 - protein, 566 aa, Artificial Sequence; identical to SEQ ID NO: 6870
  hemagglutinin__InfluenzaA__AEI86874

SEQ ID NO: 6881 - protein, 566 aa, Artificial Sequence
  hemagglutinin__InfluenzaA__AEI86894
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6882 - protein, 566 aa, Artificial Sequence
  hemagglutinin__InfluenzaA__AEI86904
MKAILVVLLYTFTTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6883 - protein, 566 aa, Artificial Sequence
  hemagglutinin__InfluenzaA__AEI86914
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPRLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6884 - protein, 566 aa, Artificial Sequence
  hemagglutinin__InfluenzaA__AEI86924
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGVFIDYEELREQLSSVSSFERFEIFPKTSSWPNHDSNKGVTAACPHAGAKSFYKNLIWLIKKGNSYPKLSKSYINDKGKEVLVLWGIHHPSTTADQQSLYQNADAYVFVGTSRYSKKFKPEIAVRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6885 - protein, 566 aa, Artificial Sequence; identical to SEQ ID NO: 6870
  hemagglutinin__InfluenzaA__AEI86934

SEQ ID NO: 6886 - protein, 566 aa, Artificial Sequence; identical to SEQ ID NO: 5584
  hemagglutinin__InfluenzaA__AEI86944

SEQ ID NO: 6887 - protein, 566 aa, Artificial Sequence
  hemagglutinin__InfluenzaA__AEI86964
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGVFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAVRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNMCMESVKNGTYDYPKYSEEAKLNREEIDGVKLESTRIYQILAIYSTVASSLVLVVSLGAISFWMCSNGSLQCRICI

SEQ ID NO: 6888 - protein, 566 aa, Artificial Sequence; identical to SEQ ID NO: 5826
  hemagglutinin__InfluenzaA__AEI86974

SEQ ID NO: 6889 - protein, 566 aa, Artificial Sequence; identical to SEQ ID NO: 5584
  hemagglutinin__InfluenzaA__AEI86984

SEQ ID NO: 6890 - protein, 566 aa, Artificial Sequence; identical to SEQ ID NO: 5584
  hemagglutinin__InfluenzaA__AEI86994

SEQ ID NO: 6891 - protein, 566 aa, Artificial Sequence
  hemagglutinin__InfluenzaA__AEI87004
MKAILVVLLYTFATANADTLCIGYHANNSTDTVDTVLEKNVTVTHSVNLLEDKHNGKLCKLKGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQGLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6892 - protein, 566 aa, Artificial Sequence
  hemagglutinin__InfluenzaA__AEI87014
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSGEAKLNREEIDGVKLESTRIYQILAIYSTVASSLVLVVSLGAISFWMCSNGSLQCRICI

SEQ ID NO: 6893 - protein, 566 aa, Artificial Sequence
  hemagglutinin__InfluenzaA__AEI87034
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAIGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6894 - protein, 566 aa, Artificial Sequence; identical to SEQ ID NO: 5584
  hemagglutinin__InfluenzaA__AEI87044

SEQ ID NO: 6895 - protein, 566 aa, Artificial Sequence; identical to SEQ ID NO: 3833
  hemagglutinin__InfluenzaA__AEI87054

SEQ ID NO: 6896 - protein, 566 aa, Artificial Sequence
  hemagglutinin__InfluenzaA__AEI87064
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 6897 - protein, 566 aa, Artificial Sequence
  hemagglutinin__InfluenzaA__AEI87074
MKATLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6898 - protein, 566 aa, Artificial Sequence
  hemagglutinin__InfluenzaA__AEI87094
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNTGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGIKLESTRIYQILAIYSTVASSLVLVVSLGAISFWMCSNGSLQCRICI

SEQ ID NO: 6899 - protein, 566 aa, Artificial Sequence; identical to SEQ ID NO: 6898
  hemagglutinin__InfluenzaA__AEI87104

SEQ ID NO: 6900 - protein, 565 aa, Artificial Sequence; identical to SEQ ID NO: 3626
  hemagglutinin__InfluenzaA__AEI91963

SEQ ID NO: 6901 - protein, 566 aa, Artificial Sequence; identical to SEQ ID NO: 3833
  hemagglutinin__InfluenzaA__AEI91977

SEQ ID NO: 6902 - protein, 566 aa, Artificial Sequence; identical to SEQ ID NO: 5357
  hemagglutinin__InfluenzaA__AEI91978

SEQ ID NO: 6903 - protein, 566 aa, Artificial Sequence; identical to SEQ ID NO: 4299
  hemagglutinin__InfluenzaA__AEI91998

SEQ ID NO: 6904 - protein, 566 aa, Artificial Sequence
  hemagglutinin__InfluenzaA__AEI91999
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSILNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6905 - protein, 565 aa, Artificial Sequence
  hemagglutinin__InfluenzaA__AEI92018
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6906 - protein, 566 aa, Artificial Sequence; identical to SEQ ID NO: 6881
  hemagglutinin__InfluenzaA__AEJ10400

SEQ ID NO: 6907 - protein, 566 aa, Artificial Sequence
  hemagglutinin__InfluenzaA__AEJ10410
MKTILVVLLYTFATANADTLCIGYHANNSTDTIDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWSDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6908 - protein, 566 aa, Artificial Sequence
  hemagglutinin__InfluenzaA__AEJ10420
MKAILVVLLYTFATANADTLCIGYHANNSTDTVDTVLEKNVTVTHSVNLLEDRHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6909 - protein, 566 aa, Artificial Sequence
  hemagglutinin__InfluenzaA__AEJ10430
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6910 - protein, 566 aa, Artificial Sequence
  hemagglutinin__InfluenzaA__AEJ10440
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQILYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6911 - protein, 566 aa, Artificial Sequence; identical to SEQ ID NO: 6824
  hemagglutinin__InfluenzaA__AEJ10450

SEQ ID NO: 6912 - protein, 566 aa, Artificial Sequence
  hemagglutinin__InfluenzaA__AEJ10480
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPQAGAKSFYKNLIWLVKKGNSYPKLSKSYINDKGKEVLVLWGIHHPSTSADQQSLYQSADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNAQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6913 - protein, 566 aa, Artificial Sequence
  hemagglutinin__InfluenzaA__AEJ10490
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGRCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLIVSLGAISFWMCSNGSLQCRICI

SEQ ID NO: 6914 - protein, 566 aa, Artificial Sequence
  hemagglutinin__InfluenzaA__AEJ10500
MKAILVVLLYTFATANADTLCIGYHANNSTDTVDTVLEKNVTVTHSVNLLEGKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLNKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6915 - protein, 566 aa, Artificial Sequence; identical to SEQ ID NO: 6867
  hemagglutinin__InfluenzaA__AEJ10510

SEQ ID NO: 6916 - protein, 566 aa, Artificial Sequence
  hemagglutinin__InfluenzaA__AEJ10520
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNYDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCSKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6917 - protein, 566 aa, Artificial Sequence; identical to SEQ ID NO: 2669
  hemagglutinin__InfluenzaA__AEJ10530

SEQ ID NO: 6918 - protein, 566 aa, Artificial Sequence; identical to SEQ ID NO: 2669
  hemagglutinin__InfluenzaA__AEJ10540

SEQ ID NO: 6919 - protein, 566 aa, Artificial Sequence; identical to SEQ ID NO: 2669
  hemagglutinin__InfluenzaA__AEJ10550

SEQ ID NO: 6920 - protein, 566 aa, Artificial Sequence
  hemagglutinin__InfluenzaA__AEJ10570
MKAILVVLLYTLATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNATCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6921 - protein, 566 aa, Artificial Sequence; identical to SEQ ID NO: 6920
  hemagglutinin__InfluenzaA__AEJ10580

SEQ ID NO: 6922 - protein, 566 aa, Artificial Sequence
  hemagglutinin__InfluenzaA__AEJ36302
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSYNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQRLYQNADAYAFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAFDEITNKVNSVIEKMNTQFTAVGKEFNHLEKRIENLNKKVDDGFLDIWTYNAELLVLLENERTLDYHDSNVKNLYEKVRSQLKNNAKETGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6923 - protein, 566 aa, Artificial Sequence
  hemagglutinin__InfluenzaA__AEJ36312
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNIQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6924 - protein, 566 aa, Artificial Sequence
  hemagglutinin__InfluenzaA__AEJ37853
MKAILVVLLYTFATANADTLCIGYHANNSTDTVDTVLEKNVTVTHSVNLLEDKHNGKLCKLRGVAPLHLGKCNIAGWILGNPECESLSTASSWSYIVEASSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNMCMESVKNGTYDYPKYSEEAKLNREEIDGVKLESTRIYQILAIYSTVASSLVLVVSLGAISFWMCSNGSLQCRICI

SEQ ID NO: 6925 - protein, 566 aa, Artificial Sequence
  hemagglutinin__InfluenzaA__AEJ37863
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKLRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6926 - protein, 566 aa, Artificial Sequence; identical to SEQ ID NO: 3833
  hemagglutinin__InfluenzaA__AEJ37873

SEQ ID NO: 6927 - protein, 566 aa, Artificial Sequence; identical to SEQ ID NO: 6881
  hemagglutinin__InfluenzaA__AEJ37883

SEQ ID NO: 6928 - protein, 566 aa, Artificial Sequence
  hemagglutinin__InfluenzaA__AEJ37893
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDKPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6929 - protein, 566 aa, Artificial Sequence; identical to SEQ ID NO: 6881
  hemagglutinin__InfluenzaA__AEJ37903

SEQ ID NO: 6930 - protein, 566 aa, Artificial Sequence
  hemagglutinin__InfluenzaA__AEJ37923
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAIERMAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6931 - protein, 566 aa, Artificial Sequence
  hemagglutinin__InfluenzaA__AEJ37943
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6932 - protein, 566 aa, Artificial Sequence; identical to SEQ ID NO: 6881
  hemagglutinin__InfluenzaA__AEJ37953

SEQ ID NO: 6933 - protein, 566 aa, Artificial Sequence
  hemagglutinin__InfluenzaA__AEJ37963
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGATNTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6934 - protein, 566 aa, Artificial Sequence; identical to SEQ ID NO: 3833
  hemagglutinin__InfluenzaA__AEJ37973

SEQ ID NO: 6935 - protein, 566 aa, Artificial Sequence; identical to SEQ ID NO: 6881
  hemagglutinin__InfluenzaA__AEJ37983

SEQ ID NO: 6936 - protein, 566 aa, Artificial Sequence; identical to SEQ ID NO: 5533
  hemagglutinin__InfluenzaA__AEK21369

SEQ ID NO: 6937 - protein, 565 aa, Artificial Sequence; identical to SEQ ID NO: 3616
  hemagglutinin__InfluenzaA__AEK21380

SEQ ID NO: 6938 - protein, 566 aa, Artificial Sequence
  hemagglutinin__InfluenzaA__AEK21396
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLLVPRYAFEMERKSGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 6939 - protein, 566 aa, Artificial Sequence
  hemagglutinin__InfluenzaA__AEK21406
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSMSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6940 - protein, 566 aa, Artificial Sequence
  hemagglutinin__InfluenzaA__AEK21416
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGVFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAVRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6941 - protein, 566 aa, Artificial Sequence
  hemagglutinin__InfluenzaA__AEK21426
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVRSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 6942 - protein, 566 aa, Artificial Sequence; identical to SEQ ID NO: 3833
  hemagglutinin__InfluenzaA__AEK21436

SEQ ID NO: 6943 - protein, 566 aa, Artificial Sequence
  hemagglutinin__InfluenzaA__AEK21456
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMENVKNGTYDYPKYSEEAKLNREEIDGVKLESTRIYQILAIYSTVASSLVLVVSLGAISFWMCSNGSLQCRICI

SEQ ID NO: 6944 - protein, 566 aa, Artificial Sequence; identical to SEQ ID NO: 6881
  hemagglutinin__InfluenzaA__AEK21466

SEQ ID NO: 6945 - protein, 566 aa, Artificial Sequence; identical to SEQ ID NO: 6881
  hemagglutinin__InfluenzaA__AEK21476

SEQ ID NO: 6946 - protein, 566 aa, Artificial Sequence; identical to SEQ ID NO: 3833
  hemagglutinin__InfluenzaA__AEK21486

SEQ ID NO: 6947 - protein, 566 aa, Artificial Sequence
  hemagglutinin__InfluenzaA__AEK28774
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6948 - protein, 566 aa, Artificial Sequence
  hemagglutinin__InfluenzaA__AEK28785
MKTIIALSYILCLVFAQNLPGNDNSAATLCLGHHAVPNGTIVKTITNDQVEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6949 - protein, 566 aa, Artificial Sequence
  hemagglutinin__InfluenzaA__AEK28796
MKTIIALSYILCLVFAQKLPGNDNSTATLCLGHHAVPNGTIVKTITNDKIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQDGTSSACIRGSKNSFFSRLNWLTHLNFKYPALNVTMPNNEQFDKLYIWGVHHPGTDKDQIFLYAQASGRITVSTKRSQQAAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6950 - protein, 566 aa, Artificial Sequence
  hemagglutinin__InfluenzaA__AEK28807
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYGNCYPYDVPDYASLRSLVASSGTLEFNNESFNWTGVTQNGTSSACIRKSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6951 - protein, 566 aa, Artificial Sequence
  hemagglutinin__InfluenzaA__AEK28818
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINNTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6952 - protein, 566 aa, Artificial Sequence
  hemagglutinin__InfluenzaA__AEK28828
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWVCQKGNIRCNICI

SEQ ID NO: 6953 - protein, 566 aa, Artificial Sequence; identical to SEQ ID NO: 2434
  hemagglutinin__InfluenzaA__AEK28839

SEQ ID NO: 6954 - protein, 566 aa, Artificial Sequence
  hemagglutinin__InfluenzaA__AEK28850
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRLRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6955 - protein, 566 aa, Artificial Sequence
  hemagglutinin__InfluenzaA__AEK28861
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLKENAEDMGNGCFKIYHKCDNACIGSIRNGTYDHDVYRDEALNNRFHIKGVELKSGYKDWILWISFATSCFLLCVALLGFIMWACQKGNIRCNICI

SEQ ID NO: 6956 - protein, 566 aa, Artificial Sequence
  hemagglutinin__InfluenzaA__AEK28872
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6957 - protein, 566 aa, Artificial Sequence
  hemagglutinin__InfluenzaA__AEK28883
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSSNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6958 - protein, 566 aa, Artificial Sequence
  hemagglutinin__InfluenzaA__AEK28894
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6959 - protein, 566 aa, Artificial Sequence
  hemagglutinin__InfluenzaA__AEK28905
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLRFKYPALNVTMPNNEQFDKLYIWGVHHPGTDNDQIFPYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6960 - protein, 566 aa, Artificial Sequence
  hemagglutinin__InfluenzaA__AEK28916
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRIRNIPSRISIYWTIVKPGDILLINSTGNLIAPRGYFKIRSGKSSVMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6961 - protein, 566 aa, Artificial Sequence
  hemagglutinin__InfluenzaA__AEK28927
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLIASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6962 - protein, 566 aa, Artificial Sequence
  hemagglutinin__InfluenzaA__AEK28949
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCLKIYHKCDNACIGSIRNGTYDHDVYRDEALNNRFQIKGVELKSGYKDWILWISFAISCFLLCVALLGFIMWACQKGNIRCNICI

SEQ ID NO: 6963 - protein, 566 aa, Artificial Sequence; identical to SEQ ID NO: 2434
  hemagglutinin__InfluenzaA__AEK28960

SEQ ID NO: 6964 - protein, 566 aa, Artificial Sequence; identical to SEQ ID NO: 2434
  hemagglutinin__InfluenzaA__AEK28971

SEQ ID NO: 6965 - protein, 566 aa, Artificial Sequence
  hemagglutinin__InfluenzaA__AEK28982
MKTIIALSYILCLVFAQKLPGNYNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6966 - protein, 566 aa, Artificial Sequence
  hemagglutinin__InfluenzaA__AEK28993
MKTIIALSYILCLVFAQKLPGNYNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEQFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6967 - protein, 566 aa, Artificial Sequence
  hemagglutinin__InfluenzaA__AEK29004
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYVSLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6968 - protein, 566 aa, Artificial Sequence
  hemagglutinin__InfluenzaA__AEK29026
MKTIIALSYILCLVFAQKLPGNDNSTATLCLGHHAVPNGTIVKTITNDQIEVTNATELVQSSSTGEICDSPHQILDGKNCTLIDALLGDPQCDGFQDKKWDLFVERSKAYSNCYPYDVPDYASLRSLVASSGTLEFNNESFNWTGVTQNGTSSACIRRSKNSFFSRLNWLTHLNFKYSALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKMQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6969 - protein, 566 aa, Artificial Sequence
  hemagglutinin__InfluenzaA__AEK29048
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVAQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6970 - protein, 566 aa, Artificial Sequence
  hemagglutinin__InfluenzaA__AEK29070
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6971 - protein, 566 aa, Artificial Sequence
  hemagglutinin__InfluenzaA__AEK29081
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSSCIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIHLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6972 - protein, 566 aa, Artificial Sequence; identical to SEQ ID NO: 5533
  hemagglutinin__InfluenzaA__AEK29092

SEQ ID NO: 6973 - protein, 566 aa, Artificial Sequence; identical to SEQ ID NO: 6855
  hemagglutinin__InfluenzaA__AEK29125

SEQ ID NO: 6974 - protein, 566 aa, Artificial Sequence; identical to SEQ ID NO: 6855
  hemagglutinin__InfluenzaA__AEK29136

SEQ ID NO: 6975 - protein, 566 aa, Artificial Sequence; identical to SEQ ID NO: 6855
  hemagglutinin__InfluenzaA__AEK29169

SEQ ID NO: 6976 - protein, 566 aa, Artificial Sequence; identical to SEQ ID NO: 6855
  hemagglutinin__InfluenzaA__AEK29180

SEQ ID NO: 6977 - protein, 566 aa, Artificial Sequence; identical to SEQ ID NO: 6855
  hemagglutinin__InfluenzaA__AEK29191

SEQ ID NO: 6978 - protein, 566 aa, Artificial Sequence; identical to SEQ ID NO: 6855
  hemagglutinin__InfluenzaA__AEK29202

SEQ ID NO: 6979 - protein, 566 aa, Artificial Sequence; identical to SEQ ID NO: 6855
  hemagglutinin__InfluenzaA__AEK29213

SEQ ID NO: 6980 - protein, 566 aa, Artificial Sequence; identical to SEQ ID NO: 6855
  hemagglutinin__InfluenzaA__AEK29224

SEQ ID NO: 6981 - protein, 566 aa, Artificial Sequence; identical to SEQ ID NO: 6855
  hemagglutinin__InfluenzaA__AEK29235

SEQ ID NO: 6982 - protein, 566 aa, Artificial Sequence
  hemagglutinin__InfluenzaA__AEK29268
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6983 - protein, 565 aa, Artificial Sequence
  hemagglutinin__InfluenzaA__AEK59838
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPDPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQKALYHTENAYVSVVSSHYSKKFTPEIAKRPKVRDQEGRINYYWTLLEPGNTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 6984 - protein, 566 aa, Artificial Sequence
  hemagglutinin__InfluenzaA__AEK98378
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFPYAQASGRITVSTKRSQQTVIPNIGSRPRVRNIPSRISIYWTIVKPGDILLINSTGNLIAPRGYFKIQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6985 - protein, 566 aa, Artificial Sequence; identical to SEQ ID NO: 1915
  hemagglutinin__InfluenzaA__AEK98380

SEQ ID NO: 6986 - protein, 566 aa, Artificial Sequence
  hemagglutinin__InfluenzaA__AEK98382
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEKFDKLYIWGVHHPGTDNDQIFLYAQASGRITVSTKRSQQTVIPNIGSRPRIRNIPSRISIYWTIVKPGDILLINSTGNLIAPRGYFKIQIGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6987 - protein, 566 aa, Artificial Sequence
  hemagglutinin__InfluenzaA__AEK98386
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRTRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6988 - protein, 566 aa, Artificial Sequence
  hemagglutinin__InfluenzaA__AEK98388
MKTIIALSYILCLVFAQKLPGNDNSTATLCLGHHAVPNGTIVKTITNDQIEVTNATELVQSSSTGEICDSPHQILDGKNCTLIDALLGDPQCDGLQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6989 - protein, 566 aa, Artificial Sequence
  hemagglutinin__InfluenzaA__AEK98390
MKTIIALSYILCLVFAQELPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCKSACITPNGSIPNDKTFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6990 - protein, 566 aa, Artificial Sequence
  hemagglutinin__InfluenzaA__AEK98392
MKTIIALSYILCLVFAQKLPGNDNSTATLCLGHHAVPNGTIVKTITDDQIEVTNATELVQSSSTGEICNSPHQILDGENCTLIDALLGDPQCDGFQNKKWDLFVERSKAHSNCYPYDVPDYASLRSLVASSGTLEFNNENFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRLRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6991 - protein, 566 aa, Artificial Sequence
  hemagglutinin__InfluenzaA__AEK98394
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRLRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6992 - protein, 566 aa, Artificial Sequence
  hemagglutinin__InfluenzaA__AEK98396
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNKSFFSRLNWLTHLKFKYPALNVTMPNNEQFDKLYIWGVHHPGTDNDQISLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 6993 - protein, 566 aa, Artificial Sequence
  hemagglutinin__InfluenzaA__AEK98398
MKTIIALSYILCLVFAQKLPGNDNSTATLCLGHHAVPNGTIVKTITNDQIEVTNATELVQSSSTGEICDSPHQILDGKNCTLIDALLGDPQCDGLQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNIPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWIIWISFAISCFLLCVALLGFIMWACQKGNIRCNICI

SEQ ID NO: 6994 - protein, 566 aa, Artificial Sequence
  hemagglutinin__InfluenzaA__AEK98400
METIIALSYILSLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNENFNWTGVTQNGTSSACIRRSNNSFFSRLNWLTHLRFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCSSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEIEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6995 - protein, 566 aa, Artificial Sequence
  hemagglutinin__InfluenzaA__AEK98402
MKTIIALSYILCLGFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAINQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6996 - protein, 566 aa, Artificial Sequence
  hemagglutinin__InfluenzaA__AEK98404
MKTIIALSYILSLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNENFNWTGVTQNGTSSACIRRSNNSFFSRLNWLTHLRFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKMRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 6997 - protein, 566 aa, Artificial Sequence
  hemagglutinin__InfluenzaA__AEK98406
MKTIIALSYILSLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNENFNWTGVTQNGTSSACIRRSNNSFFSRLNWLTHLRFKYPALNVTMPNNEELDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFVMWACQKGNIRCNICI

SEQ ID NO: 6998 - protein, 566 aa, Artificial Sequence
  hemagglutinin__InfluenzaA__AEL11687
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSSCKRRSNNSFFSRLNWLTHLKFKYPALNVTMPNNEKFDKLYIWGVHHPVTDNDQIRLYAQASGRITVSTKRSQQTVIPNIGYRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 6999 - protein, 563 aa, Artificial Sequence
  hemagglutinin__InfluenzaA__AEL31632
MEKIVLLLAIVSLVKSDQICIGYHANNSTEQVDTIMEKNVTVTHAQDILEKTHNGKLCNLDGVKPLILRDCSVAGWLLGNPMCDEFLNVPEWSYIVEKINPANDLCYPGNFNDYEELKHLLSRINHFEKIQIIPKSSWSDHEASGVSSVCPYQGRSSFFRNVVWLTKKDNAYPTIKRSYNNTNQEDLLVLWGIHHPNDAAEQTRLYQNPTTYISVGTSTLNQRLVPKIATRSKVNGQSGRMEFFWTILKSNDAINFESNGNFIAPENAYKIVKKGDSTIMKSELEYGNCNTKCQTPIGAINSSMPFHNIHPLTIGECPKYVKSNRLVLATGLRNSPQGETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLFLWMCSNGSLQCRICI

SEQ ID NO: 7000 - protein, 566 aa, Artificial Sequence; identical to SEQ ID NO: 6920
  hemagglutinin__InfluenzaA__AEL89297

SEQ ID NO: 7001 - protein, 566 aa, Artificial Sequence; identical to SEQ ID NO: 6920
  hemagglutinin__InfluenzaA__AEL89307

SEQ ID NO: 7002 - protein, 566 aa, Artificial Sequence; identical to SEQ ID NO: 6920
  hemagglutinin__InfluenzaA__AEL89317

SEQ ID NO: 7003 - protein, 566 aa, Artificial Sequence; identical to SEQ ID NO: 6920
  hemagglutinin__InfluenzaA__AEL89327

SEQ ID NO: 7004 - protein, 566 aa, Artificial Sequence; identical to SEQ ID NO: 6920
  hemagglutinin__InfluenzaA__AEL89337

SEQ ID NO: 7005 - protein, 566 aa, Artificial Sequence; identical to SEQ ID NO: 6920
  hemagglutinin__InfluenzaA__AEL89347

SEQ ID NO: 7006 - protein, 566 aa, Artificial Sequence; identical to SEQ ID NO: 6920
  hemagglutinin__InfluenzaA__AEL89357

SEQ ID NO: 7007 - protein, 566 aa, Artificial Sequence; identical to SEQ ID NO: 6920
  hemagglutinin__InfluenzaA__AEL89367

SEQ ID NO: 7008 - protein, 566 aa, Artificial Sequence; identical to SEQ ID NO: 6920
  hemagglutinin__InfluenzaA__AEL89391

SEQ ID NO: 7009 - protein, 566 aa, Artificial Sequence; identical to SEQ ID NO: 6920
  hemagglutinin__InfluenzaA__AEL89401

SEQ ID NO: 7010 - protein, 566 aa, Artificial Sequence; identical to SEQ ID NO: 6920
  hemagglutinin__InfluenzaA__AEL89411

SEQ ID NO: 7011 - protein, 566 aa, Artificial Sequence; identical to SEQ ID NO: 6920
  hemagglutinin__InfluenzaA__AEL89421

SEQ ID NO: 7012 - protein, 566 aa, Artificial Sequence; identical to SEQ ID NO: 6920
  hemagglutinin__InfluenzaA__AEL89441

SEQ ID NO: 7013 - protein, 566 aa, Artificial Sequence; identical to SEQ ID NO: 6920
  hemagglutinin__InfluenzaA__AEL89451

SEQ ID NO: 7014 - protein, 566 aa, Artificial Sequence; identical to SEQ ID NO: 6920
  hemagglutinin__InfluenzaA__AEL89461

SEQ ID NO: 7015 - protein, 566 aa, Artificial Sequence; identical to SEQ ID NO: 6920
  hemagglutinin__InfluenzaA__AEL89471

SEQ ID NO: 7016 - protein, 566 aa, Artificial Sequence
  hemagglutinin__InfluenzaA__AEL89481
MKVILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7017 - protein, 566 aa, Artificial Sequence; identical to SEQ ID NO: 5584
  hemagglutinin__InfluenzaA__AEL89491

SEQ ID NO: 7018 - protein, 566 aa, Artificial Sequence
  hemagglutinin__InfluenzaA__AEL89501
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDEGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7019 - protein, 566 aa, Artificial Sequence; identical to SEQ ID NO: 3833
  hemagglutinin__InfluenzaA__AEL89511

SEQ ID NO: 7020 - protein, 566 aa, Artificial Sequence; identical to SEQ ID NO: 5584
  hemagglutinin__InfluenzaA__AEL89521

SEQ ID NO: 7021 - protein, 566 aa, Artificial Sequence
  hemagglutinin__InfluenzaA__AEL89531
MKAILVVLLYTFTTANADTLCIGYHANNSTDTVDTVLEKNVTVTHSVNLLEDKHNGKLCQLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7022 - protein, 566 aa, Artificial Sequence; identical to SEQ ID NO: 5584
  hemagglutinin__InfluenzaA__AEL89541

SEQ ID NO: 7023 - protein, 566 aa, Artificial Sequence
  hemagglutinin__InfluenzaA__AEL89551
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7024 - protein, 566 aa, Artificial Sequence
  hemagglutinin__InfluenzaA__AEL89561
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTEIYQILAIYSTVASSLVLVVSLGAISFWMCSNGSLQCRICI

SEQ ID NO: 7025 - protein, 566 aa, Artificial Sequence; identical to SEQ ID NO: 5584
  hemagglutinin__InfluenzaA__AEL89571

SEQ ID NO: 7026 - protein, 566 aa, Artificial Sequence
  hemagglutinin__InfluenzaA__AEL89581
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7027 - protein, 566 aa, Artificial Sequence; identical to SEQ ID NO: 6454
  hemagglutinin__InfluenzaA__AEL89591

SEQ ID NO: 7028 - protein, 566 aa, Artificial Sequence
  hemagglutinin__InfluenzaA__AEL89601
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSKVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7029 - protein, 566 aa, Artificial Sequence; identical to SEQ ID NO: 6454
  hemagglutinin__InfluenzaA__AEL89611

SEQ ID NO: 7030 - protein, 566 aa, Artificial Sequence; identical to SEQ ID NO: 6896
  hemagglutinin__InfluenzaA__AEL89621

SEQ ID NO: 7031 - protein, 566 aa, Artificial Sequence; identical to SEQ ID NO: 5584
  hemagglutinin__InfluenzaA__AEL89631

SEQ ID NO: 7032 - protein, 566 aa, Artificial Sequence; identical to SEQ ID NO: 6920
  hemagglutinin__InfluenzaA__AEL89641

SEQ ID NO: 7033 - protein, 566 aa, Artificial Sequence
  hemagglutinin__InfluenzaA__AEL89651
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGVFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKFVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7034 - protein, 566 aa, Artificial Sequence; identical to SEQ ID NO: 6435
  hemagglutinin__InfluenzaA__AEL89661

SEQ ID NO: 7035 - protein, 566 aa, Artificial Sequence
  hemagglutinin__InfluenzaA__AEL89671
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQSADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7036 - protein, 566 aa, Artificial Sequence; identical to SEQ ID NO: 6435
  hemagglutinin__InfluenzaA__AEL89691

SEQ ID NO: 7037 - protein, 566 aa, Artificial Sequence
  hemagglutinin__InfluenzaA__AEL89701
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQNLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLVVSLGAISFWMCSNGSLQCRICI

SEQ ID NO: 7038 - protein, 566 aa, Artificial Sequence; identical to SEQ ID NO: 7037
  hemagglutinin__InfluenzaA__AEL89711

SEQ ID NO: 7039 - protein, 566 aa, Artificial Sequence; identical to SEQ ID NO: 6435
  hemagglutinin__InfluenzaA__AEL89721

SEQ ID NO: 7040 - protein, 566 aa, Artificial Sequence
  hemagglutinin__InfluenzaA__AEL89741
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7041 - protein, 566 aa, Artificial Sequence; identical to SEQ ID NO: 5584
  hemagglutinin__InfluenzaA__AEL89751

SEQ ID NO: 7042 - protein, 566 aa, Artificial Sequence
  hemagglutinin__InfluenzaA__AEL89761
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLVVSLGAISFWMCSNGSLQCRICI

SEQ ID NO: 7043 - protein, 566 aa, Artificial Sequence; identical to SEQ ID NO: 6920
  hemagglutinin__InfluenzaA__AEL89771

SEQ ID NO: 7044 - protein, 566 aa, Artificial Sequence; identical to SEQ ID NO: 7042
  hemagglutinin__InfluenzaA__AEL89781

SEQ ID NO: 7045 - protein, 566 aa, Artificial Sequence; identical to SEQ ID NO: 6435
  hemagglutinin__InfluenzaA__AEL89791

SEQ ID NO: 7046 - protein, 566 aa, Artificial Sequence
  hemagglutinin__InfluenzaA__AEL89801
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGVFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAVRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLILVVSLGAISFWMCSNGSLQCRICI

SEQ ID NO: 7047 - protein, 566 aa, Artificial Sequence
  hemagglutinin__InfluenzaA__AEL89812
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNATCQTPKGVINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLVVSLGAISFWMCSNGSLQCRICI

SEQ ID NO: 7048 - protein, 566 aa, Artificial Sequence; identical to SEQ ID NO: 6435
  hemagglutinin__InfluenzaA__AEL89832

SEQ ID NO: 7049 - protein, 566 aa, Artificial Sequence
  hemagglutinin__InfluenzaA__AEL89842
MKAILVVLLYTLATANADTLCIGYHANNSTDTVDTVLEKNVTVTHSVNLLEDKHDGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNATCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7050 - protein, 566 aa, Artificial Sequence
  hemagglutinin__InfluenzaA__AEL89852
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7051 - protein, 566 aa, Artificial Sequence; identical to SEQ ID NO: 6454
  hemagglutinin__InfluenzaA__AEL93568

SEQ ID NO: 7052 - protein, 566 aa, Artificial Sequence; identical to SEQ ID NO: 6435
  hemagglutinin__InfluenzaA__AEL93578

SEQ ID NO: 7053 - protein, 566 aa, Artificial Sequence
  hemagglutinin__InfluenzaA__AEL93598
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGVFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7054 - protein, 566 aa, Artificial Sequence
  hemagglutinin__InfluenzaA__AEL93618
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7055 - protein, 566 aa, Artificial Sequence; identical to SEQ ID NO: 6435
  hemagglutinin__InfluenzaA__AEL93628

SEQ ID NO: 7056 - protein, 566 aa, Artificial Sequence; identical to SEQ ID NO: 6870
  hemagglutinin__InfluenzaA__AEL93638

SEQ ID NO: 7057 - protein, 566 aa, Artificial Sequence
  hemagglutinin__InfluenzaA__AEL94870
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIKKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7058 - protein, 566 aa, Artificial Sequence
  hemagglutinin__InfluenzaA__AEL95426
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIATRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7059 - protein, 566 aa, Artificial Sequence
  hemagglutinin__InfluenzaA__AEL97631
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFKRFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPTTIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7060 - protein, 566 aa, Artificial Sequence
  hemagglutinin__InfluenzaA__AEL99664
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFKRFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7061 - protein, 566 aa, Artificial Sequence
  hemagglutinin__InfluenzaA__AEL99674
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKIIFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7062 - protein, 562 aa, Artificial Sequence; identical to SEQ ID NO: 6271
  hemagglutinin__InfluenzaA__AEM53455

SEQ ID NO: 7063 - protein, 562 aa, Artificial Sequence; identical to SEQ ID NO: 1620
  hemagglutinin__InfluenzaA__AEM53468

SEQ ID NO: 7064 - protein, 565 aa, Artificial Sequence; identical to SEQ ID NO: 2115
  hemagglutinin__InfluenzaA__AEM60037

SEQ ID NO: 7065 - protein, 565 aa, Artificial Sequence
  hemagglutinin__InfluenzaA__AEM60058
MKVKLLVLLCTFTATYADTICIGYHANNSTDTVDTVLEKNVTVTHSVNLLEESHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGESSFYRNLLWLTGKNGLYPNLSKSYANNKEKDVLVLWGVHHPPNIGDQRALYHTENAYVSVVSSHYSRRFTPEIAKRPKVRDQEGRINYYWTLLEPGDTIIFEANGNLIAPRFAFALGRGFGSGIITSNAPMDKCDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7066 - protein, 566 aa, Artificial Sequence
  hemagglutinin__InfluenzaA__AEM60069
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVKSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 7067 - protein, 566 aa, Artificial Sequence
  hemagglutinin__InfluenzaA__AEM92308
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKRNSYPKLSKSYINDKGKEVLVLWGIHHPSTSADQQSLYQNADAYVFVGSSRYSKKFKPEIAIRPKVRDQEGRMNYYWTLVEPGDKITFEATENLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 7068 - protein, 566 aa, Artificial Sequence
  hemagglutinin__InfluenzaA__AEM92318
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGEKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7069 - protein, 566 aa, Artificial Sequence
  hemagglutinin__InfluenzaA__AEM92328
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNISYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7070 - protein, 566 aa, Artificial Sequence
  hemagglutinin__InfluenzaA__AEM92348
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGEKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 7071 - protein, 566 aa, Artificial Sequence
  hemagglutinin__InfluenzaA__AEM92358
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKEGNSYPKLSKSYINDKGKEVLVLWGIHHPSTTTDQQSLYQNADAYVFVGTSRYSKKFKPEIAIRPKMRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7072 - protein, 566 aa, Artificial Sequence
  hemagglutinin__InfluenzaA__AEM92368
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7073 - protein, 566 aa, Artificial Sequence
  hemagglutinin__InfluenzaA__AEM92378
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLNSVSSFERFEIFPKTSSWPNHDSNKGVTAACPHAGAKSFYKNLIWLVKKGNSYPKLNKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7074 - protein, 566 aa, Artificial Sequence
  hemagglutinin__InfluenzaA__AEM92407
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRNQEGRMNYYWTLVEPGDKITFEATGNLVVPRYAFTIERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTHNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSMGSLQCRICI

SEQ ID NO: 7075 - protein, 566 aa, Artificial Sequence
  hemagglutinin__InfluenzaA__AEM92417
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKASSWPNHDSNKGVTAACPHAGAKSFYKNLIWLVKKENSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7076 - protein, 566 aa, Artificial Sequence
  hemagglutinin__InfluenzaA__AEM92428
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNMCMESVKNGTYDYPKYSEEAKLNREEIDGVKLESTRIYQILAIYSTVASSLVLVVSLGAISFWMCSNGSLQCRICI

SEQ ID NO: 7077 - protein, 566 aa, Artificial Sequence
  hemagglutinin__InfluenzaA__AEM92438
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKIRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7078 - protein, 566 aa, Artificial Sequence; identical to SEQ ID NO: 6809
  hemagglutinin__InfluenzaA__AEM92448

SEQ ID NO: 7079 - protein, 566 aa, Artificial Sequence; identical to SEQ ID NO: 6809
  hemagglutinin__InfluenzaA__AEM92458

SEQ ID NO: 7080 - protein, 566 aa, Artificial Sequence
  hemagglutinin__InfluenzaA__AEM92468
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKEFKPEIAVRPKVRDQEGRMNYYWTLVEPGDKITFEATGNLLVPRYAFAMERNAGSGIIISDTPVHDCNTICQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7081 - protein, 566 aa, Artificial Sequence
  hemagglutinin__InfluenzaA__AEM92478
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAVRPKVRDQEGRMNYYWTLVEPGDKITFEATGNLLVPRYAFAMERNAGSGIIISDTPVHDCNTICQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7082 - protein, 566 aa, Artificial Sequence
  hemagglutinin__InfluenzaA__AEM92498
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTNSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7083 - protein, 566 aa, Artificial Sequence
  hemagglutinin__InfluenzaA__AEM92518
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKRKEVLVLWGIHHPPTSADQQSLYQNADAYVFVGTSRYSKKFKPEIAIRPKVRDQEGRMNYYWTLVEPGDKITFEATGNLVVPRYAFAMERNAGSGIIISDTPVHDCNATCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSKVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7084 - protein, 566 aa, Artificial Sequence
  hemagglutinin__InfluenzaA__AEM92528
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKAFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7085 - protein, 566 aa, Artificial Sequence
  hemagglutinin__InfluenzaA__AEM92548
MKAILVVLLYTFATATADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7086 - protein, 566 aa, Artificial Sequence
  hemagglutinin__InfluenzaA__AEM92558
MKAILVVLLYTFATANADTLCIGYHANNSTDTVDTVLEKNVTVTHSVNLLEDKHNGKLCKLRGVAPLHLGKCSIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7087 - protein, 566 aa, Artificial Sequence; identical to SEQ ID NO: 7086
  hemagglutinin__InfluenzaA__AEM92568

SEQ ID NO: 7088 - protein, 566 aa, Artificial Sequence
  hemagglutinin__InfluenzaA__AEM92578
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7089 - protein, 566 aa, Artificial Sequence
  hemagglutinin__InfluenzaA__AEM92608
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7090 - protein, 566 aa, Artificial Sequence
  hemagglutinin__InfluenzaA__AEM92618
MKAILVVLLYTFATANADTLCIGYHANNSTDTVDTVLEKNVTVTHSVNLLEDKHNGKLCKLRGVAPLHLGKCNIAGWILGNPECESLSTANSWSYIVETSSSDNGTCYPGDFIDYEELREQLSSVSSFERFEIFPKTNSWPNHDSNKGVTAACPHAGAKSFYKNLIWLVKTGNSYPKLSKSYINDKGKEVLVLWGIHHPSTSADQQSLYQNADAYVFVGTSRYSRKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7091 - protein, 566 aa, Artificial Sequence
  hemagglutinin__InfluenzaA__AEM92638
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDTNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 7092 - protein, 566 aa, Artificial Sequence
  hemagglutinin__InfluenzaA__AEM92648
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDTNKGVTAACPHAGAKSFYKNLIWLVKEGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMEKNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 7093 - protein, 566 aa, Artificial Sequence; identical to SEQ ID NO: 5533
  hemagglutinin__InfluenzaA__AEM98407

SEQ ID NO: 7094 - protein, 566 aa, Artificial Sequence; identical to SEQ ID NO: 5533
  hemagglutinin__InfluenzaA__AEM98418

SEQ ID NO: 7095 - protein, 566 aa, Artificial Sequence; identical to SEQ ID NO: 5533
  hemagglutinin__InfluenzaA__AEM98429

SEQ ID NO: 7096 - protein, 566 aa, Artificial Sequence
  hemagglutinin__InfluenzaA__AEN55398
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLVTGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7097 - protein, 566 aa, Artificial Sequence; identical to SEQ ID NO: 6920
  hemagglutinin__InfluenzaA__AEN55408

SEQ ID NO: 7098 - protein, 566 aa, Artificial Sequence; identical to SEQ ID NO: 6435
  hemagglutinin__InfluenzaA__AEN55418

SEQ ID NO: 7099 - protein, 566 aa, Artificial Sequence; identical to SEQ ID NO: 5584
  hemagglutinin__InfluenzaA__AEN55463

SEQ ID NO: 7100 - protein, 566 aa, Artificial Sequence
  hemagglutinin__InfluenzaA__AEN55473
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTTDQQSLYQTADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7101 - protein, 566 aa, Artificial Sequence; identical to SEQ ID NO: 6435
  hemagglutinin__InfluenzaA__AEN55483

SEQ ID NO: 7102 - protein, 566 aa, Artificial Sequence; identical to SEQ ID NO: 7042
  hemagglutinin__InfluenzaA__AEN55493

SEQ ID NO: 7103 - protein, 566 aa, Artificial Sequence; identical to SEQ ID NO: 6435
  hemagglutinin__InfluenzaA__AEN55503

SEQ ID NO: 7104 - protein, 566 aa, Artificial Sequence
  hemagglutinin__InfluenzaA__AEN55513
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQNLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7105 - protein, 566 aa, Artificial Sequence; identical to SEQ ID NO: 6435
  hemagglutinin__InfluenzaA__AEN55523

SEQ ID NO: 7106 - protein, 566 aa, Artificial Sequence; identical to SEQ ID NO: 5224
  hemagglutinin__InfluenzaA__AEN68904

SEQ ID NO: 7107 - protein, 566 aa, Artificial Sequence; identical to SEQ ID NO: 2669
  hemagglutinin__InfluenzaA__AEN68905

SEQ ID NO: 7108 - protein, 566 aa, Artificial Sequence; identical to SEQ ID NO: 2669
  hemagglutinin__InfluenzaA__AEN68906

SEQ ID NO: 7109 - protein, 566 aa, Artificial Sequence; identical to SEQ ID NO: 3771
  hemagglutinin__InfluenzaA__AEN68907

SEQ ID NO: 7110 - protein, 566 aa, Artificial Sequence; identical to SEQ ID NO: 2669
  hemagglutinin__InfluenzaA__AEN68908

SEQ ID NO: 7111 - protein, 566 aa, Artificial Sequence
  hemagglutinin__InfluenzaA__AEN68909
MKAILVVLLYTFATANADTLCVGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7112 - protein, 566 aa, Artificial Sequence
  hemagglutinin__InfluenzaA__AEN68910
MKAILVVLLYTFATANADTLCVGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKGTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7113 - protein, 566 aa, Artificial Sequence; identical to SEQ ID NO: 4785
  hemagglutinin__InfluenzaA__AEN68911

SEQ ID NO: 7114 - protein, 566 aa, Artificial Sequence; identical to SEQ ID NO: 2669
  hemagglutinin__InfluenzaA__AEN68912

SEQ ID NO: 7115 - protein, 566 aa, Artificial Sequence; identical to SEQ ID NO: 2760
  hemagglutinin__InfluenzaA__AEN68913

SEQ ID NO: 7116 - protein, 566 aa, Artificial Sequence; identical to SEQ ID NO: 5335
  hemagglutinin__InfluenzaA__AEN68914

SEQ ID NO: 7117 - protein, 566 aa, Artificial Sequence; identical to SEQ ID NO: 2669
  hemagglutinin__InfluenzaA__AEN68915

SEQ ID NO: 7118 - protein, 566 aa, Artificial Sequence; identical to SEQ ID NO: 2669
  hemagglutinin__InfluenzaA__AEN68916

SEQ ID NO: 7119 - protein, 566 aa, Artificial Sequence
  hemagglutinin__InfluenzaA__AEN68917
MKAILGVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPVTIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7120 - protein, 566 aa, Artificial Sequence
  hemagglutinin__InfluenzaA__AEN68918
MKAILVVLLYTFATANADTLCIGYHANNSTDTVDTVLEKNVTVTHSVNLLEDKNNGKLCKLRGVAPLHLGKCNIAGWILGNPECESLSTASSWSYIVETSSSDNGTCYPGDFIDYEELREQLSSVSSFERFEMFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7121 - protein, 566 aa, Artificial Sequence; identical to SEQ ID NO: 5584
  hemagglutinin__InfluenzaA__AEN68919

SEQ ID NO: 7122 - protein, 566 aa, Artificial Sequence; identical to SEQ ID NO: 4833
  hemagglutinin__InfluenzaA__AEN68920

SEQ ID NO: 7123 - protein, 566 aa, Artificial Sequence; identical to SEQ ID NO: 3833
  hemagglutinin__InfluenzaA__AEN68921

SEQ ID NO: 7124 - protein, 566 aa, Artificial Sequence; identical to SEQ ID NO: 3829
  hemagglutinin__InfluenzaA__AEN68922

SEQ ID NO: 7125 - protein, 566 aa, Artificial Sequence; identical to SEQ ID NO: 3833
  hemagglutinin__InfluenzaA__AEN68923

SEQ ID NO: 7126 - protein, 566 aa, Artificial Sequence; identical to SEQ ID NO: 3833
  hemagglutinin__InfluenzaA__AEN68924

SEQ ID NO: 7127 - protein, 566 aa, Artificial Sequence
  hemagglutinin__InfluenzaA__AEN68925
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVETSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7128 - protein, 566 aa, Artificial Sequence
  hemagglutinin__InfluenzaA__AEN68926
MKAILVVLLYTFATANADTLCIGYHANNSTDTVDTVLEKNVTVTHSVNLLEDKHNGKLCKLRGVAPLHLGKCNIAGWILGNPECESLATASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGREVLVLWGIHHPSTSADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7129 - protein, 566 aa, Artificial Sequence
  hemagglutinin__InfluenzaA__AEN68927
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7130 - protein, 566 aa, Artificial Sequence; identical to SEQ ID NO: 6255
  hemagglutinin__InfluenzaA__AEN68928

SEQ ID NO: 7131 - protein, 566 aa, Artificial Sequence
  hemagglutinin__InfluenzaA__AEN68929
MKAILVVLLYTFATANADTLCIGYHANNSTDTVDTVLEKNVTVTHSVNLLEDKHNGKLCKLRGIAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7132 - protein, 566 aa, Artificial Sequence; identical to SEQ ID NO: 5584
  hemagglutinin__InfluenzaA__AEN68930

SEQ ID NO: 7133 - protein, 566 aa, Artificial Sequence; identical to SEQ ID NO: 5584
  hemagglutinin__InfluenzaA__AEN68931

SEQ ID NO: 7134 - protein, 566 aa, Artificial Sequence; identical to SEQ ID NO: 5584
  hemagglutinin__InfluenzaA__AEN68932

SEQ ID NO: 7135 - protein, 566 aa, Artificial Sequence
  hemagglutinin__InfluenzaA__AEN69426
MKAILVVLLYTFATSNADTLCIGYHANNSTDTVDTVLEKNVTVTHSVNLLEDKHNGKLCKLRGVAPLHLGKCNIAGWILGNPECESLSTASSWSYIVETSSSDNGTCYPGNFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7136 - protein, 566 aa, Artificial Sequence; identical to SEQ ID NO: 6920
  hemagglutinin__InfluenzaA__AEN69475

SEQ ID NO: 7137 - protein, 566 aa, Artificial Sequence; identical to SEQ ID NO: 6920
  hemagglutinin__InfluenzaA__AEN69481

SEQ ID NO: 7138 - protein, 566 aa, Artificial Sequence; identical to SEQ ID NO: 2922
  hemagglutinin__InfluenzaA__AEO01032

SEQ ID NO: 7139 - protein, 566 aa, Artificial Sequence; identical to SEQ ID NO: 3022
  hemagglutinin__InfluenzaA__AEO01033

SEQ ID NO: 7140 - protein, 566 aa, Artificial Sequence; identical to SEQ ID NO: 3022
  hemagglutinin__InfluenzaA__AEO01034

SEQ ID NO: 7141 - protein, 566 aa, Artificial Sequence; identical to SEQ ID NO: 2656
  hemagglutinin__InfluenzaA__AEO01035

SEQ ID NO: 7142 - protein, 566 aa, Artificial Sequence; identical to SEQ ID NO: 3022
  hemagglutinin__InfluenzaA__AEO01036

SEQ ID NO: 7143 - protein, 566 aa, Artificial Sequence; identical to SEQ ID NO: 2911
  hemagglutinin__InfluenzaA__AEO01037

SEQ ID NO: 7144 - protein, 566 aa, Artificial Sequence; identical to SEQ ID NO: 3022
  hemagglutinin__InfluenzaA__AEO01038

SEQ ID NO: 7145 - protein, 566 aa, Artificial Sequence; identical to SEQ ID NO: 2849
  hemagglutinin__InfluenzaA__AEO01039

SEQ ID NO: 7146 - protein, 566 aa, Artificial Sequence
  hemagglutinin__InfluenzaA__AEO01040
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKKVLVLWGIHHPSTSADQQSLYQNADAYVFVGTSRYSKKFKPEIAIRPKVRDQEGRMNYYWTLIEPGDKITFEATGNLVVPRYAFTMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7147 - protein, 566 aa, Artificial Sequence; identical to SEQ ID NO: 2669
  hemagglutinin__InfluenzaA__AEO01041

SEQ ID NO: 7148 - protein, 566 aa, Artificial Sequence; identical to SEQ ID NO: 3022
  hemagglutinin__InfluenzaA__AEO01042

SEQ ID NO: 7149 - protein, 566 aa, Artificial Sequence
  hemagglutinin__InfluenzaA__AEO01043
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSNNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7150 - protein, 566 aa, Artificial Sequence; identical to SEQ ID NO: 2669
  hemagglutinin__InfluenzaA__AEO01044

SEQ ID NO: 7151 - protein, 566 aa, Artificial Sequence
  hemagglutinin__InfluenzaA__AEO01045
MKAILVVLLYTFATANADTLCIGYHANNSTDTVDTVLEKNVTVTHSVNLLEDKHNGKLCKLRGVAPLHLGKCNIAGWILGNLECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7152 - protein, 566 aa, Artificial Sequence; identical to SEQ ID NO: 2669
  hemagglutinin__InfluenzaA__AEO01046

SEQ ID NO: 7153 - protein, 566 aa, Artificial Sequence; identical to SEQ ID NO: 2669
  hemagglutinin__InfluenzaA__AEO01047

SEQ ID NO: 7154 - protein, 566 aa, Artificial Sequence
  hemagglutinin__InfluenzaA__AEO01048
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCKICI

SEQ ID NO: 7155 - protein, 566 aa, Artificial Sequence; identical to SEQ ID NO: 3567
  hemagglutinin__InfluenzaA__AEO01049

SEQ ID NO: 7156 - protein, 566 aa, Artificial Sequence; identical to SEQ ID NO: 2669
  hemagglutinin__InfluenzaA__AEO01050

SEQ ID NO: 7157 - protein, 566 aa, Artificial Sequence; identical to SEQ ID NO: 3022
  hemagglutinin__InfluenzaA__AEO01051

SEQ ID NO: 7158 - protein, 566 aa, Artificial Sequence
  hemagglutinin__InfluenzaA__AEO01052
MKAIIVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7159 - protein, 566 aa, Artificial Sequence; identical to SEQ ID NO: 3022
  hemagglutinin__InfluenzaA__AEO01053

SEQ ID NO: 7160 - protein, 566 aa, Artificial Sequence; identical to SEQ ID NO: 2669
  hemagglutinin__InfluenzaA__AEO01054

SEQ ID NO: 7161 - protein, 566 aa, Artificial Sequence; identical to SEQ ID NO: 3481
  hemagglutinin__InfluenzaA__AEO01055

SEQ ID NO: 7162 - protein, 566 aa, Artificial Sequence; identical to SEQ ID NO: 3022
  hemagglutinin__InfluenzaA__AEO01056

SEQ ID NO: 7163 - protein, 566 aa, Artificial Sequence; identical to SEQ ID NO: 2669
  hemagglutinin__InfluenzaA__AEO01057

SEQ ID NO: 7164 - protein, 566 aa, Artificial Sequence; identical to SEQ ID NO: 2669
  hemagglutinin__InfluenzaA__AEO01058

SEQ ID NO: 7165 - protein, 566 aa, Artificial Sequence; identical to SEQ ID NO: 2669
  hemagglutinin__InfluenzaA__AEO01059

SEQ ID NO: 7166 - protein, 566 aa, Artificial Sequence; identical to SEQ ID NO: 2669
  hemagglutinin__InfluenzaA__AEO01060

SEQ ID NO: 7167 - protein, 566 aa, Artificial Sequence; identical to SEQ ID NO: 2669
  hemagglutinin__InfluenzaA__AEO01061

SEQ ID NO: 7168 - protein, 566 aa, Artificial Sequence; identical to SEQ ID NO: 2669
  hemagglutinin__InfluenzaA__AEO01062

SEQ ID NO: 7169 - protein, 566 aa, Artificial Sequence; identical to SEQ ID NO: 2669
  hemagglutinin__InfluenzaA__AEO01063

SEQ ID NO: 7170 - protein, 566 aa, Artificial Sequence; identical to SEQ ID NO: 2669
  hemagglutinin__InfluenzaA__AEO01064

SEQ ID NO: 7171 - protein, 566 aa, Artificial Sequence; identical to SEQ ID NO: 2911
  hemagglutinin__InfluenzaA__AEO01065

SEQ ID NO: 7172 - protein, 566 aa, Artificial Sequence; identical to SEQ ID NO: 3022
  hemagglutinin__InfluenzaA__AEO01066

SEQ ID NO: 7173 - protein, 566 aa, Artificial Sequence
  hemagglutinin__InfluenzaA__AEO01067
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEMAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7174 - protein, 566 aa, Artificial Sequence; identical to SEQ ID NO: 3022
  hemagglutinin__InfluenzaA__AEO01068

SEQ ID NO: 7175 - protein, 566 aa, Artificial Sequence; identical to SEQ ID NO: 2669
  hemagglutinin__InfluenzaA__AEO01069

SEQ ID NO: 7176 - protein, 566 aa, Artificial Sequence; identical to SEQ ID NO: 3022
  hemagglutinin__InfluenzaA__AEO01070

SEQ ID NO: 7177 - protein, 566 aa, Artificial Sequence; identical to SEQ ID NO: 2669
  hemagglutinin__InfluenzaA__AEO01071

SEQ ID NO: 7178 - protein, 566 aa, Artificial Sequence
  hemagglutinin__InfluenzaA__AEO01073
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAVNTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7179 - protein, 566 aa, Artificial Sequence; identical to SEQ ID NO: 2911
  hemagglutinin__InfluenzaA__AEO01074

SEQ ID NO: 7180 - protein, 566 aa, Artificial Sequence; identical to SEQ ID NO: 3022
  hemagglutinin__InfluenzaA__AEO01075

SEQ ID NO: 7181 - protein, 566 aa, Artificial Sequence; identical to SEQ ID NO: 3022
  hemagglutinin__InfluenzaA__AEO01076

SEQ ID NO: 7182 - protein, 566 aa, Artificial Sequence
  hemagglutinin__InfluenzaA__AEO01077
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMENVKNGTYDYPKYSEEAKLNREEIDGVKLESTRIYQILAIYSTVASSLVLVVSLGAISFWMCSNGSLQCRICI

SEQ ID NO: 7183 - protein, 566 aa, Artificial Sequence; identical to SEQ ID NO: 2669
  hemagglutinin__InfluenzaA__AEO01078

SEQ ID NO: 7184 - protein, 566 aa, Artificial Sequence; identical to SEQ ID NO: 2669
  hemagglutinin__InfluenzaA__AEO01079

SEQ ID NO: 7185 - protein, 566 aa, Artificial Sequence; identical to SEQ ID NO: 2669
  hemagglutinin__InfluenzaA__AEO01080

SEQ ID NO: 7186 - protein, 566 aa, Artificial Sequence; identical to SEQ ID NO: 3022
  hemagglutinin__InfluenzaA__AEO01081

SEQ ID NO: 7187 - protein, 566 aa, Artificial Sequence; identical to SEQ ID NO: 2669
  hemagglutinin__InfluenzaA__AEO01082

SEQ ID NO: 7188 - protein, 566 aa, Artificial Sequence; identical to SEQ ID NO: 2669
  hemagglutinin__InfluenzaA__AEO01083

SEQ ID NO: 7189 - protein, 566 aa, Artificial Sequence; identical to SEQ ID NO: 2669
  hemagglutinin__InfluenzaA__AEO01084

SEQ ID NO: 7190 - protein, 566 aa, Artificial Sequence; identical to SEQ ID NO: 3022
  hemagglutinin__InfluenzaA__AEO01085

SEQ ID NO: 7191 - protein, 566 aa, Artificial Sequence; identical to SEQ ID NO: 2669
  hemagglutinin__InfluenzaA__AEO01086

SEQ ID NO: 7192 - protein, 566 aa, Artificial Sequence; identical to SEQ ID NO: 3022
  hemagglutinin__InfluenzaA__AEO01087

SEQ ID NO: 7193 - protein, 566 aa, Artificial Sequence; identical to SEQ ID NO: 2849
  hemagglutinin__InfluenzaA__AEO01088

SEQ ID NO: 7194 - protein, 566 aa, Artificial Sequence; identical to SEQ ID NO: 3022
  hemagglutinin__InfluenzaA__AEO01089

SEQ ID NO: 7195 - protein, 566 aa, Artificial Sequence; identical to SEQ ID NO: 3022
  hemagglutinin__InfluenzaA__AEO01090

SEQ ID NO: 7196 - protein, 566 aa, Artificial Sequence; identical to SEQ ID NO: 3022
  hemagglutinin__InfluenzaA__AEO01091

SEQ ID NO: 7197 - protein, 566 aa, Artificial Sequence
  hemagglutinin__InfluenzaA__AEO01092
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYERVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7198 - protein, 566 aa, Artificial Sequence; identical to SEQ ID NO: 2669
  hemagglutinin__InfluenzaA__AEO01093

SEQ ID NO: 7199 - protein, 566 aa, Artificial Sequence; identical to SEQ ID NO: 2669
  hemagglutinin__InfluenzaA__AEO01094

SEQ ID NO: 7200 - protein, 566 aa, Artificial Sequence; identical to SEQ ID NO: 5876
  hemagglutinin__InfluenzaA__AEO01095

SEQ ID NO: 7201 - protein, 566 aa, Artificial Sequence; identical to SEQ ID NO: 3022
  hemagglutinin__InfluenzaA__AEO01096

SEQ ID NO: 7202 - protein, 566 aa, Artificial Sequence; identical to SEQ ID NO: 3022
  hemagglutinin__InfluenzaA__AEO01097

SEQ ID NO: 7203 - protein, 566 aa, Artificial Sequence; identical to SEQ ID NO: 3022
  hemagglutinin__InfluenzaA__AEO01098

SEQ ID NO: 7204 - protein, 566 aa, Artificial Sequence; identical to SEQ ID NO: 2669
  hemagglutinin__InfluenzaA__AEO01099

SEQ ID NO: 7205 - protein, 566 aa, Artificial Sequence; identical to SEQ ID NO: 2911
  hemagglutinin__InfluenzaA__AEO01100

SEQ ID NO: 7206 - protein, 566 aa, Artificial Sequence; identical to SEQ ID NO: 2669
  hemagglutinin__InfluenzaA__AEO01101

SEQ ID NO: 7207 - protein, 566 aa, Artificial Sequence; identical to SEQ ID NO: 2669
  hemagglutinin__InfluenzaA__AEO01102

SEQ ID NO: 7208 - protein, 566 aa, Artificial Sequence; identical to SEQ ID NO: 3022
  hemagglutinin__InfluenzaA__AEO01103

SEQ ID NO: 7209 - protein, 566 aa, Artificial Sequence; identical to SEQ ID NO: 3022
  hemagglutinin__InfluenzaA__AEO01104

SEQ ID NO: 7210 - protein, 566 aa, Artificial Sequence
  hemagglutinin__InfluenzaA__AEO01105
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSSKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7211 - protein, 566 aa, Artificial Sequence; identical to SEQ ID NO: 3022
  hemagglutinin__InfluenzaA__AEO01106

SEQ ID NO: 7212 - protein, 566 aa, Artificial Sequence; identical to SEQ ID NO: 2669
  hemagglutinin__InfluenzaA__AEO01107

SEQ ID NO: 7213 - protein, 566 aa, Artificial Sequence; identical to SEQ ID NO: 2669
  hemagglutinin__InfluenzaA__AEO01108

SEQ ID NO: 7214 - protein, 566 aa, Artificial Sequence; identical to SEQ ID NO: 2669
  hemagglutinin__InfluenzaA__AEO01109

SEQ ID NO: 7215 - protein, 566 aa, Artificial Sequence; identical to SEQ ID NO: 2669
  hemagglutinin__InfluenzaA__AEO01110

SEQ ID NO: 7216 - protein, 566 aa, Artificial Sequence; identical to SEQ ID NO: 2669
  hemagglutinin__InfluenzaA__AEO01111

SEQ ID NO: 7217 - protein, 566 aa, Artificial Sequence; identical to SEQ ID NO: 2669
  hemagglutinin__InfluenzaA__AEO01112

SEQ ID NO: 7218 - protein, 566 aa, Artificial Sequence
  hemagglutinin__InfluenzaA__AEO01113
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACLHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7219 - protein, 566 aa, Artificial Sequence; identical to SEQ ID NO: 2911
  hemagglutinin__InfluenzaA__AEO01114

SEQ ID NO: 7220 - protein, 566 aa, Artificial Sequence
  hemagglutinin__InfluenzaA__AEO01115
MEAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACLHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFHNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7221 - protein, 566 aa, Artificial Sequence; identical to SEQ ID NO: 2669
  hemagglutinin__InfluenzaA__AEO01116

SEQ ID NO: 7222 - protein, 566 aa, Artificial Sequence; identical to SEQ ID NO: 2669
  hemagglutinin__InfluenzaA__AEO01117

SEQ ID NO: 7223 - protein, 566 aa, Artificial Sequence; identical to SEQ ID NO: 3535
  hemagglutinin__InfluenzaA__AEO01118

SEQ ID NO: 7224 - protein, 566 aa, Artificial Sequence; identical to SEQ ID NO: 2669
  hemagglutinin__InfluenzaA__AEO01119

SEQ ID NO: 7225 - protein, 566 aa, Artificial Sequence
  hemagglutinin__InfluenzaA__AEO01120
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDVWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7226 - protein, 566 aa, Artificial Sequence; identical to SEQ ID NO: 2669
  hemagglutinin__InfluenzaA__AEO01121

SEQ ID NO: 7227 - protein, 566 aa, Artificial Sequence; identical to SEQ ID NO: 3022
  hemagglutinin__InfluenzaA__AEO01122

SEQ ID NO: 7228 - protein, 566 aa, Artificial Sequence; identical to SEQ ID NO: 2669
  hemagglutinin__InfluenzaA__AEO01123

SEQ ID NO: 7229 - protein, 566 aa, Artificial Sequence; identical to SEQ ID NO: 2669
  hemagglutinin__InfluenzaA__AEO01124

SEQ ID NO: 7230 - protein, 566 aa, Artificial Sequence; identical to SEQ ID NO: 3022
  hemagglutinin__InfluenzaA__AEO01125

SEQ ID NO: 7231 - protein, 566 aa, Artificial Sequence
  hemagglutinin__InfluenzaA__AEO01126
MKATLVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7232 - protein, 566 aa, Artificial Sequence; identical to SEQ ID NO: 2669
  hemagglutinin__InfluenzaA__AEO01127

SEQ ID NO: 7233 - protein, 566 aa, Artificial Sequence; identical to SEQ ID NO: 2669
  hemagglutinin__InfluenzaA__AEO01128

SEQ ID NO: 7234 - protein, 566 aa, Artificial Sequence; identical to SEQ ID NO: 3022
  hemagglutinin__InfluenzaA__AEO01129

SEQ ID NO: 7235 - protein, 566 aa, Artificial Sequence; identical to SEQ ID NO: 2669
  hemagglutinin__InfluenzaA__AEO01130

SEQ ID NO: 7236 - protein, 566 aa, Artificial Sequence; identical to SEQ ID NO: 3022
  hemagglutinin__InfluenzaA__AEO01131

SEQ ID NO: 7237 - protein, 566 aa, Artificial Sequence; identical to SEQ ID NO: 2669
  hemagglutinin__InfluenzaA__AEO01132

SEQ ID NO: 7238 - protein, 566 aa, Artificial Sequence
  hemagglutinin__InfluenzaA__AEO01133
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLVVSLGAISFWMCSNGSLQCRICI

SEQ ID NO: 7239 - protein, 566 aa, Artificial Sequence; identical to SEQ ID NO: 3022
  hemagglutinin__InfluenzaA__AEO01134

SEQ ID NO: 7240 - protein, 566 aa, Artificial Sequence; identical to SEQ ID NO: 3022
  hemagglutinin__InfluenzaA__AEO01135

SEQ ID NO: 7241 - protein, 566 aa, Artificial Sequence; identical to SEQ ID NO: 2669
  hemagglutinin__InfluenzaA__AEO01136

SEQ ID NO: 7242 - protein, 566 aa, Artificial Sequence; identical to SEQ ID NO: 3116
  hemagglutinin__InfluenzaA__AEO01137

SEQ ID NO: 7243 - protein, 566 aa, Artificial Sequence; identical to SEQ ID NO: 3116
  hemagglutinin__InfluenzaA__AEO01138

SEQ ID NO: 7244 - protein, 566 aa, Artificial Sequence; identical to SEQ ID NO: 2669
  hemagglutinin__InfluenzaA__AEO01139

SEQ ID NO: 7245 - protein, 566 aa, Artificial Sequence; identical to SEQ ID NO: 2669
  hemagglutinin__InfluenzaA__AEO01140

SEQ ID NO: 7246 - protein, 566 aa, Artificial Sequence; identical to SEQ ID NO: 2669
  hemagglutinin__InfluenzaA__AEO01141

SEQ ID NO: 7247 - protein, 566 aa, Artificial Sequence; identical to SEQ ID NO: 2669
  hemagglutinin__InfluenzaA__AEO01142

SEQ ID NO: 7248 - protein, 566 aa, Artificial Sequence
  hemagglutinin__InfluenzaA__AEO01144
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSISDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7249 - protein, 566 aa, Artificial Sequence; identical to SEQ ID NO: 2849
  hemagglutinin__InfluenzaA__AEO01145

SEQ ID NO: 7250 - protein, 566 aa, Artificial Sequence
  hemagglutinin__InfluenzaA__AEO01146
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFNPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7251 - protein, 566 aa, Artificial Sequence; identical to SEQ ID NO: 2669
  hemagglutinin__InfluenzaA__AEO01147

SEQ ID NO: 7252 - protein, 566 aa, Artificial Sequence; identical to SEQ ID NO: 3022
  hemagglutinin__InfluenzaA__AEO01148

SEQ ID NO: 7253 - protein, 566 aa, Artificial Sequence; identical to SEQ ID NO: 3022
  hemagglutinin__InfluenzaA__AEO01149

SEQ ID NO: 7254 - protein, 566 aa, Artificial Sequence; identical to SEQ ID NO: 5876
  hemagglutinin__InfluenzaA__AEO01150

SEQ ID NO: 7255 - protein, 566 aa, Artificial Sequence; identical to SEQ ID NO: 2669
  hemagglutinin__InfluenzaA__AEO01151

SEQ ID NO: 7256 - protein, 566 aa, Artificial Sequence
  hemagglutinin__InfluenzaA__AEO01152
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7257 - protein, 566 aa, Artificial Sequence
  hemagglutinin__InfluenzaA__AEO01153
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINNKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISNTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7258 - protein, 566 aa, Artificial Sequence; identical to SEQ ID NO: 2669
  hemagglutinin__InfluenzaA__AEO01154

SEQ ID NO: 7259 - protein, 566 aa, Artificial Sequence; identical to SEQ ID NO: 3022
  hemagglutinin__InfluenzaA__AEO01155

SEQ ID NO: 7260 - protein, 566 aa, Artificial Sequence; identical to SEQ ID NO: 3022
  hemagglutinin__InfluenzaA__AEO01156

SEQ ID NO: 7261 - protein, 566 aa, Artificial Sequence; identical to SEQ ID NO: 2669
  hemagglutinin__InfluenzaA__AEO01157

SEQ ID NO: 7262 - protein, 566 aa, Artificial Sequence; identical to SEQ ID NO: 2669
  hemagglutinin__InfluenzaA__AEO01158

SEQ ID NO: 7263 - protein, 566 aa, Artificial Sequence; identical to SEQ ID NO: 2669
  hemagglutinin__InfluenzaA__AEO01159

SEQ ID NO: 7264 - protein, 566 aa, Artificial Sequence
  hemagglutinin__InfluenzaA__AEO01160
MKAILVALLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7265 - protein, 566 aa, Artificial Sequence; identical to SEQ ID NO: 2669
  hemagglutinin__InfluenzaA__AEO01161

SEQ ID NO: 7266 - protein, 566 aa, Artificial Sequence; identical to SEQ ID NO: 3022
  hemagglutinin__InfluenzaA__AEO01162

SEQ ID NO: 7267 - protein, 566 aa, Artificial Sequence; identical to SEQ ID NO: 3022
  hemagglutinin__InfluenzaA__AEO01163

SEQ ID NO: 7268 - protein, 566 aa, Artificial Sequence; identical to SEQ ID NO: 3022
  hemagglutinin__InfluenzaA__AEO01164

SEQ ID NO: 7269 - protein, 566 aa, Artificial Sequence
  hemagglutinin__InfluenzaA__AEO01165
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKFSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7270 - protein, 566 aa, Artificial Sequence; identical to SEQ ID NO: 3022
  hemagglutinin__InfluenzaA__AEO01166

SEQ ID NO: 7271 - protein, 566 aa, Artificial Sequence
  hemagglutinin__InfluenzaA__AEO01167
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7272 - protein, 566 aa, Artificial Sequence; identical to SEQ ID NO: 2669
  hemagglutinin__InfluenzaA__AEO01168

SEQ ID NO: 7273 - protein, 566 aa, Artificial Sequence; identical to SEQ ID NO: 3022
  hemagglutinin__InfluenzaA__AEO01169

SEQ ID NO: 7274 - protein, 566 aa, Artificial Sequence; identical to SEQ ID NO: 3022
  hemagglutinin__InfluenzaA__AEO01170

SEQ ID NO: 7275 - protein, 566 aa, Artificial Sequence; identical to SEQ ID NO: 3022
  hemagglutinin__InfluenzaA__AEO01171

SEQ ID NO: 7276 - protein, 566 aa, Artificial Sequence; identical to SEQ ID NO: 2669
  hemagglutinin__InfluenzaA__AEO01172

SEQ ID NO: 7277 - protein, 566 aa, Artificial Sequence
  hemagglutinin__InfluenzaA__AEO01173
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGGKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7278 - protein, 566 aa, Artificial Sequence
  hemagglutinin__InfluenzaA__AEO01174
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7279 - protein, 566 aa, Artificial Sequence; identical to SEQ ID NO: 2669
  hemagglutinin__InfluenzaA__AEO01176

SEQ ID NO: 7280 - protein, 566 aa, Artificial Sequence; identical to SEQ ID NO: 2669
  hemagglutinin__InfluenzaA__AEO01177

SEQ ID NO: 7281 - protein, 566 aa, Artificial Sequence; identical to SEQ ID NO: 3022
  hemagglutinin__InfluenzaA__AEO01179

SEQ ID NO: 7282 - protein, 566 aa, Artificial Sequence; identical to SEQ ID NO: 3022
  hemagglutinin__InfluenzaA__AEO01180

SEQ ID NO: 7283 - protein, 566 aa, Artificial Sequence; identical to SEQ ID NO: 3022
  hemagglutinin__InfluenzaA__AEO01181

SEQ ID NO: 7284 - protein, 566 aa, Artificial Sequence; identical to SEQ ID NO: 3022
  hemagglutinin__InfluenzaA__AEO01182

SEQ ID NO: 7285 - protein, 566 aa, Artificial Sequence; identical to SEQ ID NO: 2669
  hemagglutinin__InfluenzaA__AEO01183

SEQ ID NO: 7286 - protein, 566 aa, Artificial Sequence; identical to SEQ ID NO: 3022
  hemagglutinin__InfluenzaA__AEO01184

SEQ ID NO: 7287 - protein, 566 aa, Artificial Sequence; identical to SEQ ID NO: 2669
  hemagglutinin__InfluenzaA__AEO01185

SEQ ID NO: 7288 - protein, 566 aa, Artificial Sequence; identical to SEQ ID NO: 2669
  hemagglutinin__InfluenzaA__AEO01186

SEQ ID NO: 7289 - protein, 566 aa, Artificial Sequence; identical to SEQ ID NO: 2669
  hemagglutinin__InfluenzaA__AEO01187

SEQ ID NO: 7290 - protein, 566 aa, Artificial Sequence; identical to SEQ ID NO: 2669
  hemagglutinin__InfluenzaA__AEO01188

SEQ ID NO: 7291 - protein, 566 aa, Artificial Sequence; identical to SEQ ID NO: 2669
  hemagglutinin__InfluenzaA__AEO01189

SEQ ID NO: 7292 - protein, 566 aa, Artificial Sequence; identical to SEQ ID NO: 2669
  hemagglutinin__InfluenzaA__AEO01191

SEQ ID NO: 7293 - protein, 566 aa, Artificial Sequence; identical to SEQ ID NO: 2669
  hemagglutinin__InfluenzaA__AEO01192

SEQ ID NO: 7294 - protein, 566 aa, Artificial Sequence; identical to SEQ ID NO: 3983
  hemagglutinin__InfluenzaA__AEO01193

SEQ ID NO: 7295 - protein, 566 aa, Artificial Sequence; identical to SEQ ID NO: 3022
  hemagglutinin__InfluenzaA__AEO01194

SEQ ID NO: 7296 - protein, 566 aa, Artificial Sequence; identical to SEQ ID NO: 3022
  hemagglutinin__InfluenzaA__AEO01195

SEQ ID NO: 7297 - protein, 566 aa, Artificial Sequence; identical to SEQ ID NO: 2669
  hemagglutinin__InfluenzaA__AEO01196

SEQ ID NO: 7298 - protein, 566 aa, Artificial Sequence; identical to SEQ ID NO: 2669
  hemagglutinin__InfluenzaA__AEO01197

SEQ ID NO: 7299 - protein, 566 aa, Artificial Sequence; identical to SEQ ID NO: 3022
  hemagglutinin__InfluenzaA__AEO01198

SEQ ID NO: 7300 - protein, 566 aa, Artificial Sequence; identical to SEQ ID NO: 3535
  hemagglutinin__InfluenzaA__AEO01200

SEQ ID NO: 7301 - protein, 566 aa, Artificial Sequence
  hemagglutinin__InfluenzaA__AEO01201
MKAILVVLLYTFATANADTLCIGYHANNSTDTVDTVLEKNVTVTHSVNLLEEKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7302 - protein, 566 aa, Artificial Sequence; identical to SEQ ID NO: 2669
  hemagglutinin__InfluenzaA__AEO01202

SEQ ID NO: 7303 - protein, 566 aa, Artificial Sequence; identical to SEQ ID NO: 4305
  hemagglutinin__InfluenzaA__AEO01203

SEQ ID NO: 7304 - protein, 566 aa, Artificial Sequence; identical to SEQ ID NO: 2669
  hemagglutinin__InfluenzaA__AEO01204

SEQ ID NO: 7305 - protein, 566 aa, Artificial Sequence; identical to SEQ ID NO: 2669
  hemagglutinin__InfluenzaA__AEO01205

SEQ ID NO: 7306 - protein, 566 aa, Artificial Sequence; identical to SEQ ID NO: 2669
  hemagglutinin__InfluenzaA__AEO01206

SEQ ID NO: 7307 - protein, 566 aa, Artificial Sequence; identical to SEQ ID NO: 2669
  hemagglutinin__InfluenzaA__AEO01207

SEQ ID NO: 7308 - protein, 566 aa, Artificial Sequence; identical to SEQ ID NO: 2669
  hemagglutinin__InfluenzaA__AEO01208

SEQ ID NO: 7309 - protein, 566 aa, Artificial Sequence; identical to SEQ ID NO: 3022
  hemagglutinin__InfluenzaA__AEO01209

SEQ ID NO: 7310 - protein, 566 aa, Artificial Sequence; identical to SEQ ID NO: 2669
  hemagglutinin__InfluenzaA__AEO01210

SEQ ID NO: 7311 - protein, 566 aa, Artificial Sequence; identical to SEQ ID NO: 3022
  hemagglutinin__InfluenzaA__AEO01211

SEQ ID NO: 7312 - protein, 566 aa, Artificial Sequence; identical to SEQ ID NO: 2669
  hemagglutinin__InfluenzaA__AEO01212

SEQ ID NO: 7313 - protein, 566 aa, Artificial Sequence; identical to SEQ ID NO: 2669
  hemagglutinin__InfluenzaA__AEO01213

SEQ ID NO: 7314 - protein, 566 aa, Artificial Sequence
  hemagglutinin__InfluenzaA__AEO01214
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVAPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7315 - protein, 566 aa, Artificial Sequence; identical to SEQ ID NO: 3022
  hemagglutinin__InfluenzaA__AEO01215

SEQ ID NO: 7316 - protein, 566 aa, Artificial Sequence
  hemagglutinin__InfluenzaA__AEO01216
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRVENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7317 - protein, 566 aa, Artificial Sequence; identical to SEQ ID NO: 3022
  hemagglutinin__InfluenzaA__AEO01217

SEQ ID NO: 7318 - protein, 566 aa, Artificial Sequence; identical to SEQ ID NO: 3022
  hemagglutinin__InfluenzaA__AEO01218

SEQ ID NO: 7319 - protein, 566 aa, Artificial Sequence; identical to SEQ ID NO: 3022
  hemagglutinin__InfluenzaA__AEO01219

SEQ ID NO: 7320 - protein, 566 aa, Artificial Sequence; identical to SEQ ID NO: 2760
  hemagglutinin__InfluenzaA__AEO01220

SEQ ID NO: 7321 - protein, 566 aa, Artificial Sequence; identical to SEQ ID NO: 2669
  hemagglutinin__InfluenzaA__AEO01221

SEQ ID NO: 7322 - protein, 566 aa, Artificial Sequence; identical to SEQ ID NO: 2669
  hemagglutinin__InfluenzaA__AEO01222

SEQ ID NO: 7323 - protein, 566 aa, Artificial Sequence; identical to SEQ ID NO: 3022
  hemagglutinin__InfluenzaA__AEO01223

SEQ ID NO: 7324 - protein, 566 aa, Artificial Sequence
  hemagglutinin__InfluenzaA__AEO01224
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFATERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7325 - protein, 566 aa, Artificial Sequence
  hemagglutinin__InfluenzaA__AEO01225
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTVVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7326 - protein, 566 aa, Artificial Sequence
  hemagglutinin__InfluenzaA__AEO01226
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNDGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7327 - protein, 566 aa, Artificial Sequence; identical to SEQ ID NO: 4836
  hemagglutinin__InfluenzaA__AEO01227

SEQ ID NO: 7328 - protein, 566 aa, Artificial Sequence; identical to SEQ ID NO: 2669
  hemagglutinin__InfluenzaA__AEO01228

SEQ ID NO: 7329 - protein, 566 aa, Artificial Sequence; identical to SEQ ID NO: 2669
  hemagglutinin__InfluenzaA__AEO01229

SEQ ID NO: 7330 - protein, 566 aa, Artificial Sequence
  hemagglutinin__InfluenzaA__AEO01230
MKAILVVLLYTFATANADTLCIGYHANNSTDTVDTVLERNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 7331 - protein, 566 aa, Artificial Sequence; identical to SEQ ID NO: 2669
  hemagglutinin__InfluenzaA__AEO01231

SEQ ID NO: 7332 - protein, 566 aa, Artificial Sequence; identical to SEQ ID NO: 3022
  hemagglutinin__InfluenzaA__AEO01232

SEQ ID NO: 7333 - protein, 566 aa, Artificial Sequence; identical to SEQ ID NO: 2669
  hemagglutinin__InfluenzaA__AEO01233

SEQ ID NO: 7334 - protein, 566 aa, Artificial Sequence; identical to SEQ ID NO: 2669
  hemagglutinin__InfluenzaA__AEO01234

SEQ ID NO: 7335 - protein, 566 aa, Artificial Sequence; identical to SEQ ID NO: 2669
  hemagglutinin__InfluenzaA__AEO01235

SEQ ID NO: 7336 - protein, 566 aa, Artificial Sequence; identical to SEQ ID NO: 6541
  hemagglutinin__InfluenzaA__AEO01236

SEQ ID NO: 7337 - protein, 566 aa, Artificial Sequence; identical to SEQ ID NO: 2669
  hemagglutinin__InfluenzaA__AEO01237

SEQ ID NO: 7338 - protein, 566 aa, Artificial Sequence; identical to SEQ ID NO: 2669
  hemagglutinin__InfluenzaA__AEO01238

SEQ ID NO: 7339 - protein, 566 aa, Artificial Sequence; identical to SEQ ID NO: 2669
  hemagglutinin__InfluenzaA__AEO01240

SEQ ID NO: 7340 - protein, 566 aa, Artificial Sequence; identical to SEQ ID NO: 3022
  hemagglutinin__InfluenzaA__AEO01241

SEQ ID NO: 7341 - protein, 566 aa, Artificial Sequence; identical to SEQ ID NO: 2669
  hemagglutinin__InfluenzaA__AEO01242

SEQ ID NO: 7342 - protein, 566 aa, Artificial Sequence
  hemagglutinin__InfluenzaA__AEO01244
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7343 - protein, 566 aa, Artificial Sequence; identical to SEQ ID NO: 2669
  hemagglutinin__InfluenzaA__AEO01245

SEQ ID NO: 7344 - protein, 566 aa, Artificial Sequence
  hemagglutinin__InfluenzaA__AEO01247
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGILISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7345 - protein, 566 aa, Artificial Sequence; identical to SEQ ID NO: 2669
  hemagglutinin__InfluenzaA__AEO01248

SEQ ID NO: 7346 - protein, 566 aa, Artificial Sequence; identical to SEQ ID NO: 2669
  hemagglutinin__InfluenzaA__AEO01249

SEQ ID NO: 7347 - protein, 566 aa, Artificial Sequence
  hemagglutinin__InfluenzaA__AEO01250
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNEDAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7348 - protein, 566 aa, Artificial Sequence; identical to SEQ ID NO: 4266
  hemagglutinin__InfluenzaA__AEO01251

SEQ ID NO: 7349 - protein, 566 aa, Artificial Sequence; identical to SEQ ID NO: 2669
  hemagglutinin__InfluenzaA__AEO01252

SEQ ID NO: 7350 - protein, 566 aa, Artificial Sequence; identical to SEQ ID NO: 2669
  hemagglutinin__InfluenzaA__AEO01253

SEQ ID NO: 7351 - protein, 566 aa, Artificial Sequence
  hemagglutinin__InfluenzaA__AEO01254
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINNKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7352 - protein, 566 aa, Artificial Sequence; identical to SEQ ID NO: 3116
  hemagglutinin__InfluenzaA__AEO01256

SEQ ID NO: 7353 - protein, 566 aa, Artificial Sequence; identical to SEQ ID NO: 6088
  hemagglutinin__InfluenzaA__AEO01257

SEQ ID NO: 7354 - protein, 566 aa, Artificial Sequence; identical to SEQ ID NO: 2669
  hemagglutinin__InfluenzaA__AEO01258

SEQ ID NO: 7355 - protein, 566 aa, Artificial Sequence; identical to SEQ ID NO: 7351
  hemagglutinin__InfluenzaA__AEO01259

SEQ ID NO: 7356 - protein, 566 aa, Artificial Sequence; identical to SEQ ID NO: 5224
  hemagglutinin__InfluenzaA__AEO01260

SEQ ID NO: 7357 - protein, 566 aa, Artificial Sequence
  hemagglutinin__InfluenzaA__AEO01261
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTGIYQILAIYSTVASSLVLVVSLGAISFWMCSNGSLQCRICI

SEQ ID NO: 7358 - protein, 566 aa, Artificial Sequence; identical to SEQ ID NO: 2669
  hemagglutinin__InfluenzaA__AEO01262

SEQ ID NO: 7359 - protein, 566 aa, Artificial Sequence; identical to SEQ ID NO: 4351
  hemagglutinin__InfluenzaA__AEO01263

SEQ ID NO: 7360 - protein, 566 aa, Artificial Sequence; identical to SEQ ID NO: 3022
  hemagglutinin__InfluenzaA__AEO01264

SEQ ID NO: 7361 - protein, 566 aa, Artificial Sequence; identical to SEQ ID NO: 2669
  hemagglutinin__InfluenzaA__AEO01265

SEQ ID NO: 7362 - protein, 566 aa, Artificial Sequence
  hemagglutinin__InfluenzaA__AEO01266
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDAPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7363 - protein, 566 aa, Artificial Sequence; identical to SEQ ID NO: 2669
  hemagglutinin__InfluenzaA__AEO01267

SEQ ID NO: 7364 - protein, 566 aa, Artificial Sequence; identical to SEQ ID NO: 2669
  hemagglutinin__InfluenzaA__AEO01268

SEQ ID NO: 7365 - protein, 566 aa, Artificial Sequence
  hemagglutinin__InfluenzaA__AEO01269
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRMENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7366 - protein, 566 aa, Artificial Sequence; identical to SEQ ID NO: 3833
  hemagglutinin__InfluenzaA__AEO01270

SEQ ID NO: 7367 - protein, 566 aa, Artificial Sequence
  hemagglutinin__InfluenzaA__AEO01271
MKAILVVLLYTFATANADTLCIGYHANNSTDTVDTVLEKNVTVTHSVNLLEDKHNGKLCKLRGVAPLHLGKCDIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7368 - protein, 566 aa, Artificial Sequence; identical to SEQ ID NO: 2669
  hemagglutinin__InfluenzaA__AEO01272

SEQ ID NO: 7369 - protein, 566 aa, Artificial Sequence; identical to SEQ ID NO: 2669
  hemagglutinin__InfluenzaA__AEO01273

SEQ ID NO: 7370 - protein, 566 aa, Artificial Sequence; identical to SEQ ID NO: 2669
  hemagglutinin__InfluenzaA__AEO01274

SEQ ID NO: 7371 - protein, 566 aa, Artificial Sequence; identical to SEQ ID NO: 4837
  hemagglutinin__InfluenzaA__AEO01275

SEQ ID NO: 7372 - protein, 566 aa, Artificial Sequence
  hemagglutinin__InfluenzaA__AEO01276
MKAILVVLLYTFATANADTLCIGYHANNSTDTVDTVLKKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAEEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7373 - protein, 566 aa, Artificial Sequence; identical to SEQ ID NO: 2669
  hemagglutinin__InfluenzaA__AEO01277

SEQ ID NO: 7374 - protein, 566 aa, Artificial Sequence
  hemagglutinin__InfluenzaA__AEO01278
MKAILVVLLYTFATANADTLCIGYHANNSTDTVDTVLEKNVTVTHSVNLLEDKHNGKLCKLRGVAPLHLGKCDIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIANLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7375 - protein, 566 aa, Artificial Sequence
  hemagglutinin__InfluenzaA__AEO01279
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERTAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7376 - protein, 566 aa, Artificial Sequence
  hemagglutinin__InfluenzaA__AEO01282
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCNNTCMESVKNGTYDYPKYSEEAKLNREEIDGVKLESTRIYQILAIYSTVASSLVLVVSLGAISFWMCSNGSLQCRICI

SEQ ID NO: 7377 - protein, 566 aa, Artificial Sequence; identical to SEQ ID NO: 3771
  hemagglutinin__InfluenzaA__AEO01283

SEQ ID NO: 7378 - protein, 566 aa, Artificial Sequence
  hemagglutinin__InfluenzaA__AEO01284
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 7379 - protein, 566 aa, Artificial Sequence; identical to SEQ ID NO: 3770
  hemagglutinin__InfluenzaA__AEO01285

SEQ ID NO: 7380 - protein, 566 aa, Artificial Sequence; identical to SEQ ID NO: 3863
  hemagglutinin__InfluenzaA__AEO01286

SEQ ID NO: 7381 - protein, 566 aa, Artificial Sequence
  hemagglutinin__InfluenzaA__AEO01287
MKAILVVLLYTFATANSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7382 - protein, 566 aa, Artificial Sequence; identical to SEQ ID NO: 3022
  hemagglutinin__InfluenzaA__AEO01288

SEQ ID NO: 7383 - protein, 566 aa, Artificial Sequence; identical to SEQ ID NO: 2669
  hemagglutinin__InfluenzaA__AEO01289

SEQ ID NO: 7384 - protein, 566 aa, Artificial Sequence
  hemagglutinin__InfluenzaA__AEO01290
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLSFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7385 - protein, 566 aa, Artificial Sequence; identical to SEQ ID NO: 2669
  hemagglutinin__InfluenzaA__AEO01291

SEQ ID NO: 7386 - protein, 566 aa, Artificial Sequence; identical to SEQ ID NO: 2669
  hemagglutinin__InfluenzaA__AEO01292

SEQ ID NO: 7387 - protein, 566 aa, Artificial Sequence
  hemagglutinin__InfluenzaA__AEO01294
MKAILVVLLYTFATANADTLCIGYHANNSTDTVDTVLEKNVTVTHSVNLLEDKHNGKLCKLRGVAPLHLGKCDIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7388 - protein, 566 aa, Artificial Sequence
  hemagglutinin__InfluenzaA__AEO01295
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHYCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7389 - protein, 566 aa, Artificial Sequence; identical to SEQ ID NO: 2669
  hemagglutinin__InfluenzaA__AEO01296

SEQ ID NO: 7390 - protein, 566 aa, Artificial Sequence; identical to SEQ ID NO: 4351
  hemagglutinin__InfluenzaA__AEO01297

SEQ ID NO: 7391 - protein, 566 aa, Artificial Sequence; identical to SEQ ID NO: 4356
  hemagglutinin__InfluenzaA__AEO01298

SEQ ID NO: 7392 - protein, 566 aa, Artificial Sequence; identical to SEQ ID NO: 2669
  hemagglutinin__InfluenzaA__AEO01299

SEQ ID NO: 7393 - protein, 566 aa, Artificial Sequence; identical to SEQ ID NO: 2669
  hemagglutinin__InfluenzaA__AEO01300

SEQ ID NO: 7394 - protein, 566 aa, Artificial Sequence; identical to SEQ ID NO: 2669
  hemagglutinin__InfluenzaA__AEO01301

SEQ ID NO: 7395 - protein, 566 aa, Artificial Sequence; identical to SEQ ID NO: 2669
  hemagglutinin__InfluenzaA__AEO01302

SEQ ID NO: 7396 - protein, 566 aa, Artificial Sequence; identical to SEQ ID NO: 4266
  hemagglutinin__InfluenzaA__AEO01303

SEQ ID NO: 7397 - protein, 566 aa, Artificial Sequence
  hemagglutinin__InfluenzaA__AEO01304
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKASSWPNHDSNKGVTAACPHAGAKSFYKNLIWLVKKGNSYPKLSKSYINDKGKGVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7398 - protein, 566 aa, Artificial Sequence
  hemagglutinin__InfluenzaA__AEO01305
MKAILVVLLYTFATASADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7399 - protein, 566 aa, Artificial Sequence; identical to SEQ ID NO: 2669
  hemagglutinin__InfluenzaA__AEO01306

SEQ ID NO: 7400 - protein, 566 aa, Artificial Sequence; identical to SEQ ID NO: 2669
  hemagglutinin__InfluenzaA__AEO01307

SEQ ID NO: 7401 - protein, 566 aa, Artificial Sequence; identical to SEQ ID NO: 2669
  hemagglutinin__InfluenzaA__AEO01308

SEQ ID NO: 7402 - protein, 566 aa, Artificial Sequence
  hemagglutinin__InfluenzaA__AEO01309
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSKEAKLNREEINGVKLESTRIYQILAIYSTVASSLVLVVSLGAISFWMCSNGSLQCRICI

SEQ ID NO: 7403 - protein, 566 aa, Artificial Sequence
  hemagglutinin__InfluenzaA__AEO01310
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDRGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7404 - protein, 566 aa, Artificial Sequence; identical to SEQ ID NO: 2669
  hemagglutinin__InfluenzaA__AEO01311

SEQ ID NO: 7405 - protein, 566 aa, Artificial Sequence
  hemagglutinin__InfluenzaA__AEO01312
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGIVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7406 - protein, 566 aa, Artificial Sequence; identical to SEQ ID NO: 3022
  hemagglutinin__InfluenzaA__AEO01313

SEQ ID NO: 7407 - protein, 566 aa, Artificial Sequence; identical to SEQ ID NO: 3833
  hemagglutinin__InfluenzaA__AEO01314

SEQ ID NO: 7408 - protein, 566 aa, Artificial Sequence
  hemagglutinin__InfluenzaA__AEO01315
MKAILVVLLYTFATANADTLCIGYHANNSTDTVDTVLEKNVTVTHSVNLLEDKHNRKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7409 - protein, 566 aa, Artificial Sequence; identical to SEQ ID NO: 2669
  hemagglutinin__InfluenzaA__AEO01316

SEQ ID NO: 7410 - protein, 566 aa, Artificial Sequence; identical to SEQ ID NO: 2669
  hemagglutinin__InfluenzaA__AEO01317

SEQ ID NO: 7411 - protein, 566 aa, Artificial Sequence; identical to SEQ ID NO: 2669
  hemagglutinin__InfluenzaA__AEO01318

SEQ ID NO: 7412 - protein, 566 aa, Artificial Sequence; identical to SEQ ID NO: 2669
  hemagglutinin__InfluenzaA__AEO01319

SEQ ID NO: 7413 - protein, 566 aa, Artificial Sequence
  hemagglutinin__InfluenzaA__AEO01321
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLALLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7414 - protein, 566 aa, Artificial Sequence; identical to SEQ ID NO: 2669
  hemagglutinin__InfluenzaA__AEO01322

SEQ ID NO: 7415 - protein, 566 aa, Artificial Sequence; identical to SEQ ID NO: 4351
  hemagglutinin__InfluenzaA__AEO01323

SEQ ID NO: 7416 - protein, 566 aa, Artificial Sequence; identical to SEQ ID NO: 4266
  hemagglutinin__InfluenzaA__AEO01324

SEQ ID NO: 7417 - protein, 566 aa, Artificial Sequence; identical to SEQ ID NO: 2669
  hemagglutinin__InfluenzaA__AEO01325

SEQ ID NO: 7418 - protein, 566 aa, Artificial Sequence
  hemagglutinin__InfluenzaA__AEO01326
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQDADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7419 - protein, 566 aa, Artificial Sequence; identical to SEQ ID NO: 2669
  hemagglutinin__InfluenzaA__AEO01327

SEQ ID NO: 7420 - protein, 566 aa, Artificial Sequence; identical to SEQ ID NO: 7378
  hemagglutinin__InfluenzaA__AEO01328

SEQ ID NO: 7421 - protein, 566 aa, Artificial Sequence; identical to SEQ ID NO: 2669
  hemagglutinin__InfluenzaA__AEO01330

SEQ ID NO: 7422 - protein, 566 aa, Artificial Sequence
  hemagglutinin__InfluenzaA__AEO01331
MKAILVVLLYTFATANADTLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7423 - protein, 566 aa, Artificial Sequence
  hemagglutinin__InfluenzaA__AEO01332
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGLSRYSKKFKPEIAIRPKVREQEGRMNYYWTLVEPGDKITFEATGNLVVPRYAFAMERNAGSGIVISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRMENLNKKVDDGFLDIWTYNAELLVLLENERTLDYHDSNVKNLYEKVRSQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7424 - protein, 566 aa, Artificial Sequence; identical to SEQ ID NO: 4837
  hemagglutinin__InfluenzaA__AEO01333

SEQ ID NO: 7425 - protein, 566 aa, Artificial Sequence
  hemagglutinin__InfluenzaA__AEO01334
MKAILVVLLYTFATANADTLCIGYHANNSTDTVDTILEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7426 - protein, 566 aa, Artificial Sequence; identical to SEQ ID NO: 4266
  hemagglutinin__InfluenzaA__AEO01335

SEQ ID NO: 7427 - protein, 566 aa, Artificial Sequence
  hemagglutinin__InfluenzaA__AEO01336
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7428 - protein, 566 aa, Artificial Sequence
  hemagglutinin__InfluenzaA__AEO01337
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7429 - protein, 566 aa, Artificial Sequence; identical to SEQ ID NO: 2669
  hemagglutinin__InfluenzaA__AEO01338

SEQ ID NO: 7430 - protein, 566 aa, Artificial Sequence; identical to SEQ ID NO: 6541
  hemagglutinin__InfluenzaA__AEO01339

SEQ ID NO: 7431 - protein, 566 aa, Artificial Sequence; identical to SEQ ID NO: 7387
  hemagglutinin__InfluenzaA__AEO01340

SEQ ID NO: 7432 - protein, 566 aa, Artificial Sequence; identical to SEQ ID NO: 7387
  hemagglutinin__InfluenzaA__AEO01341

SEQ ID NO: 7433 - protein, 566 aa, Artificial Sequence; identical to SEQ ID NO: 2669
  hemagglutinin__InfluenzaA__AEO01342

SEQ ID NO: 7434 - protein, 566 aa, Artificial Sequence
  hemagglutinin__InfluenzaA__AEO01343
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7435 - protein, 566 aa, Artificial Sequence
  hemagglutinin__InfluenzaA__AEO01344
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSKYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7436 - protein, 566 aa, Artificial Sequence; identical to SEQ ID NO: 6541
  hemagglutinin__InfluenzaA__AEO01345

SEQ ID NO: 7437 - protein, 566 aa, Artificial Sequence; identical to SEQ ID NO: 2669
  hemagglutinin__InfluenzaA__AEO01346

SEQ ID NO: 7438 - protein, 566 aa, Artificial Sequence
  hemagglutinin__InfluenzaA__AEO01347
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7439 - protein, 566 aa, Artificial Sequence
  hemagglutinin__InfluenzaA__AEO01348
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7440 - protein, 566 aa, Artificial Sequence
  hemagglutinin__InfluenzaA__AEO01349
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSENGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSKEAKLNREEIDGVKLESTRIYQILAIYSTVASSLVLVVSLGAISFWMCSNGSLQCRICI

SEQ ID NO: 7441 - protein, 566 aa, Artificial Sequence
  hemagglutinin__InfluenzaA__AEO01350
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7442 - protein, 566 aa, Artificial Sequence; identical to SEQ ID NO: 2669
  hemagglutinin__InfluenzaA__AEO01351

SEQ ID NO: 7443 - protein, 566 aa, Artificial Sequence; identical to SEQ ID NO: 3833
  hemagglutinin__InfluenzaA__AEO01352

SEQ ID NO: 7444 - protein, 566 aa, Artificial Sequence
  hemagglutinin__InfluenzaA__AEO01353
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVFLGAISFWMCSNGSLQCRICI

SEQ ID NO: 7445 - protein, 566 aa, Artificial Sequence
  hemagglutinin__InfluenzaA__AEO01354
MKAILVVLLYKFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7446 - protein, 566 aa, Artificial Sequence; identical to SEQ ID NO: 4089
  hemagglutinin__InfluenzaA__AEO01355

SEQ ID NO: 7447 - protein, 566 aa, Artificial Sequence; identical to SEQ ID NO: 2669
  hemagglutinin__InfluenzaA__AEO01356

SEQ ID NO: 7448 - protein, 566 aa, Artificial Sequence
  hemagglutinin__InfluenzaA__AEO01358
MKAILVVLLYTFATANADTLCVGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7449 - protein, 566 aa, Artificial Sequence; identical to SEQ ID NO: 4089
  hemagglutinin__InfluenzaA__AEO01359

SEQ ID NO: 7450 - protein, 566 aa, Artificial Sequence; identical to SEQ ID NO: 7422
  hemagglutinin__InfluenzaA__AEO01360

SEQ ID NO: 7451 - protein, 566 aa, Artificial Sequence; identical to SEQ ID NO: 3022
  hemagglutinin__InfluenzaA__AEO01361

SEQ ID NO: 7452 - protein, 566 aa, Artificial Sequence; identical to SEQ ID NO: 7422
  hemagglutinin__InfluenzaA__AEO01362

SEQ ID NO: 7453 - protein, 566 aa, Artificial Sequence; identical to SEQ ID NO: 3833
  hemagglutinin__InfluenzaA__AEO01363

SEQ ID NO: 7454 - protein, 566 aa, Artificial Sequence
  hemagglutinin__InfluenzaA__AEO01365
MKAILVVLLYTFATANADTLCIGYHANNSTDTVDTVLKKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERSAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7455 - protein, 566 aa, Artificial Sequence
  hemagglutinin__InfluenzaA__AEO01366
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCSTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7456 - protein, 566 aa, Artificial Sequence; identical to SEQ ID NO: 7427
  hemagglutinin__InfluenzaA__AEO01367

SEQ ID NO: 7457 - protein, 566 aa, Artificial Sequence
  hemagglutinin__InfluenzaA__AEO01368
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPNTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7458 - protein, 566 aa, Artificial Sequence; identical to SEQ ID NO: 2669
  hemagglutinin__InfluenzaA__AEO01369

SEQ ID NO: 7459 - protein, 566 aa, Artificial Sequence; identical to SEQ ID NO: 7387
  hemagglutinin__InfluenzaA__AEO01370

SEQ ID NO: 7460 - protein, 566 aa, Artificial Sequence; identical to SEQ ID NO: 7434
  hemagglutinin__InfluenzaA__AEO01371

SEQ ID NO: 7461 - protein, 566 aa, Artificial Sequence; identical to SEQ ID NO: 4266
  hemagglutinin__InfluenzaA__AEO01372

SEQ ID NO: 7462 - protein, 566 aa, Artificial Sequence; identical to SEQ ID NO: 4266
  hemagglutinin__InfluenzaA__AEO01373

SEQ ID NO: 7463 - protein, 566 aa, Artificial Sequence
  hemagglutinin__InfluenzaA__AEO01374
MKAILVVLLYTFATANADTLCIGYHANNSTDTVDTVLEKNVTVTHSVNLLEDKHNGKLCKLRGVAPLHLGKCDIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYIKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7464 - protein, 566 aa, Artificial Sequence; identical to SEQ ID NO: 7438
  hemagglutinin__InfluenzaA__AEO01375

SEQ ID NO: 7465 - protein, 566 aa, Artificial Sequence; identical to SEQ ID NO: 2669
  hemagglutinin__InfluenzaA__AEO01376

SEQ ID NO: 7466 - protein, 566 aa, Artificial Sequence; identical to SEQ ID NO: 4837
  hemagglutinin__InfluenzaA__AEO01377

SEQ ID NO: 7467 - protein, 566 aa, Artificial Sequence
  hemagglutinin__InfluenzaA__AEO01378
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7468 - protein, 566 aa, Artificial Sequence; identical to SEQ ID NO: 3833
  hemagglutinin__InfluenzaA__AEO01379

SEQ ID NO: 7469 - protein, 566 aa, Artificial Sequence; identical to SEQ ID NO: 7438
  hemagglutinin__InfluenzaA__AEO01380

SEQ ID NO: 7470 - protein, 566 aa, Artificial Sequence; identical to SEQ ID NO: 7438
  hemagglutinin__InfluenzaA__AEO01381

SEQ ID NO: 7471 - protein, 566 aa, Artificial Sequence; identical to SEQ ID NO: 3833
  hemagglutinin__InfluenzaA__AEO01382

SEQ ID NO: 7472 - protein, 566 aa, Artificial Sequence; identical to SEQ ID NO: 4266
  hemagglutinin__InfluenzaA__AEO01383

SEQ ID NO: 7473 - protein, 566 aa, Artificial Sequence
  hemagglutinin__InfluenzaA__AEO01384
MKAILVVLLYTFATANADTLCIGYHANNSTDTVDTVLEKNVTVTHSVNLLEDKHNGKLCKLRGVSPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7474 - protein, 566 aa, Artificial Sequence
  hemagglutinin__InfluenzaA__AEO01385
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNANAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7475 - protein, 566 aa, Artificial Sequence; identical to SEQ ID NO: 7378
  hemagglutinin__InfluenzaA__AEO01386

SEQ ID NO: 7476 - protein, 566 aa, Artificial Sequence
  hemagglutinin__InfluenzaA__AEO01387
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNIQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7477 - protein, 566 aa, Artificial Sequence
  hemagglutinin__InfluenzaA__AEO01388
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7478 - protein, 566 aa, Artificial Sequence
  hemagglutinin__InfluenzaA__AEO01389
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGTKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7479 - protein, 566 aa, Artificial Sequence
  hemagglutinin__InfluenzaA__AEO01390
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVETSRYSKKVKPEIAIRPRVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEVAKLNREEINGVKLESTRIYQILAIYSTVASSLVLVVSLGAISFWMCSNGSLQCRICI

SEQ ID NO: 7480 - protein, 566 aa, Artificial Sequence; identical to SEQ ID NO: 7378
  hemagglutinin__InfluenzaA__AEO01391

SEQ ID NO: 7481 - protein, 566 aa, Artificial Sequence; identical to SEQ ID NO: 7387
  hemagglutinin__InfluenzaA__AEO01392

SEQ ID NO: 7482 - protein, 566 aa, Artificial Sequence; identical to SEQ ID NO: 4266
  hemagglutinin__InfluenzaA__AEO01393

SEQ ID NO: 7483 - protein, 566 aa, Artificial Sequence; identical to SEQ ID NO: 3770
  hemagglutinin__InfluenzaA__AEO01394

SEQ ID NO: 7484 - protein, 566 aa, Artificial Sequence
  hemagglutinin__InfluenzaA__AEO01395
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFLDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7485 - protein, 566 aa, Artificial Sequence; identical to SEQ ID NO: 3770
  hemagglutinin__InfluenzaA__AEO01396

SEQ ID NO: 7486 - protein, 566 aa, Artificial Sequence
  hemagglutinin__InfluenzaA__AEO01397
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNTDAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7487 - protein, 566 aa, Artificial Sequence
  hemagglutinin__InfluenzaA__AEO01398
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADANVFVGTSRYSKKFKPEIAIRPKVRGQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7488 - protein, 566 aa, Artificial Sequence; identical to SEQ ID NO: 7387
  hemagglutinin__InfluenzaA__AEO01399

SEQ ID NO: 7489 - protein, 566 aa, Artificial Sequence; identical to SEQ ID NO: 2669
  hemagglutinin__InfluenzaA__AEO01402

SEQ ID NO: 7490 - protein, 566 aa, Artificial Sequence; identical to SEQ ID NO: 3833
  hemagglutinin__InfluenzaA__AEO01403

SEQ ID NO: 7491 - protein, 566 aa, Artificial Sequence; identical to SEQ ID NO: 2669
  hemagglutinin__InfluenzaA__AEO01404

SEQ ID NO: 7492 - protein, 566 aa, Artificial Sequence
  hemagglutinin__InfluenzaA__AEO01405
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTMIYQILAIYSTVASSLVLVVSLGAISFWMCSNGSLQCRICI

SEQ ID NO: 7493 - protein, 566 aa, Artificial Sequence
  hemagglutinin__InfluenzaA__AEO01407
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 7494 - protein, 566 aa, Artificial Sequence
  hemagglutinin__InfluenzaA__AEO01408
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKIDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7495 - protein, 566 aa, Artificial Sequence; identical to SEQ ID NO: 3771
  hemagglutinin__InfluenzaA__AEO01409

SEQ ID NO: 7496 - protein, 566 aa, Artificial Sequence; identical to SEQ ID NO: 7387
  hemagglutinin__InfluenzaA__AEO01410

SEQ ID NO: 7497 - protein, 566 aa, Artificial Sequence; identical to SEQ ID NO: 6088
  hemagglutinin__InfluenzaA__AEO01411

SEQ ID NO: 7498 - protein, 566 aa, Artificial Sequence; identical to SEQ ID NO: 3022
  hemagglutinin__InfluenzaA__AEO01412

SEQ ID NO: 7499 - protein, 566 aa, Artificial Sequence
  hemagglutinin__InfluenzaA__AEO01413
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKSNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7500 - protein, 566 aa, Artificial Sequence
  hemagglutinin__InfluenzaA__AEO01414
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNTGSGIIISDTPVHDCSTTCQTPKGAINTSLPFQNVHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7501 - protein, 566 aa, Artificial Sequence; identical to SEQ ID NO: 6300
  hemagglutinin__InfluenzaA__AEO01416

SEQ ID NO: 7502 - protein, 566 aa, Artificial Sequence; identical to SEQ ID NO: 3833
  hemagglutinin__InfluenzaA__AEO01418

SEQ ID NO: 7503 - protein, 566 aa, Artificial Sequence; identical to SEQ ID NO: 3833
  hemagglutinin__InfluenzaA__AEO01419

SEQ ID NO: 7504 - protein, 566 aa, Artificial Sequence
  hemagglutinin__InfluenzaA__AEO01420
MKAILVVLLYTFATANADTLCIGYHANNSTDTVDTVLEKNVTVTHSVNLLEYKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7505 - protein, 566 aa, Artificial Sequence
  hemagglutinin__InfluenzaA__AEO01421
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7506 - protein, 566 aa, Artificial Sequence
  hemagglutinin__InfluenzaA__AEO01422
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNLYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 7507 - protein, 566 aa, Artificial Sequence
  hemagglutinin__InfluenzaA__AEO01423
MKAILIVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEITIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7508 - protein, 566 aa, Artificial Sequence; identical to SEQ ID NO: 7505
  hemagglutinin__InfluenzaA__AEO01424

SEQ ID NO: 7509 - protein, 566 aa, Artificial Sequence; identical to SEQ ID NO: 7505
  hemagglutinin__InfluenzaA__AEO01425

SEQ ID NO: 7510 - protein, 566 aa, Artificial Sequence; identical to SEQ ID NO: 2669
  hemagglutinin__InfluenzaA__AEO01426

SEQ ID NO: 7511 - protein, 566 aa, Artificial Sequence
  hemagglutinin__InfluenzaA__AEO01427
MKAILVVLLYTFATANSDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7512 - protein, 566 aa, Artificial Sequence
  hemagglutinin__InfluenzaA__AEO01428
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPDHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7513 - protein, 566 aa, Artificial Sequence; identical to SEQ ID NO: 3833
  hemagglutinin__InfluenzaA__AEO01429

SEQ ID NO: 7514 - protein, 566 aa, Artificial Sequence
  hemagglutinin__InfluenzaA__AEO01430
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHDGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7515 - protein, 566 aa, Artificial Sequence; identical to SEQ ID NO: 7387
  hemagglutinin__InfluenzaA__AEO01431

SEQ ID NO: 7516 - protein, 566 aa, Artificial Sequence; identical to SEQ ID NO: 2669
  hemagglutinin__InfluenzaA__AEO01432

SEQ ID NO: 7517 - protein, 566 aa, Artificial Sequence
  hemagglutinin__InfluenzaA__AEO01434
MKAILVVLLYTFATANADTLCIGYHANNSTDTVDTVLEKNVTVTHSVNLLEDKHNGKLCKLRGVAPLHLGECNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7518 - protein, 566 aa, Artificial Sequence
  hemagglutinin__InfluenzaA__AEO01435
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVYDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7519 - protein, 566 aa, Artificial Sequence; identical to SEQ ID NO: 7505
  hemagglutinin__InfluenzaA__AEO01436

SEQ ID NO: 7520 - protein, 566 aa, Artificial Sequence; identical to SEQ ID NO: 7387
  hemagglutinin__InfluenzaA__AEO01437

SEQ ID NO: 7521 - protein, 566 aa, Artificial Sequence; identical to SEQ ID NO: 7438
  hemagglutinin__InfluenzaA__AEO01438

SEQ ID NO: 7522 - protein, 566 aa, Artificial Sequence; identical to SEQ ID NO: 3022
  hemagglutinin__InfluenzaA__AEO01440

SEQ ID NO: 7523 - protein, 566 aa, Artificial Sequence
  hemagglutinin__InfluenzaA__AEO01441
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNDGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7524 - protein, 566 aa, Artificial Sequence; identical to SEQ ID NO: 4089
  hemagglutinin__InfluenzaA__AEO01442

SEQ ID NO: 7525 - protein, 566 aa, Artificial Sequence
  hemagglutinin__InfluenzaA__AEO01443
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7526 - protein, 566 aa, Artificial Sequence
  hemagglutinin__InfluenzaA__AEO01444
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7527 - protein, 566 aa, Artificial Sequence; identical to SEQ ID NO: 4837
  hemagglutinin__InfluenzaA__AEO01445

SEQ ID NO: 7528 - protein, 566 aa, Artificial Sequence; identical to SEQ ID NO: 7387
  hemagglutinin__InfluenzaA__AEO01446

SEQ ID NO: 7529 - protein, 566 aa, Artificial Sequence
  hemagglutinin__InfluenzaA__AEO01447
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTIASSLVLVVSLGAISFWMCSNGSLQCRICI

SEQ ID NO: 7530 - protein, 566 aa, Artificial Sequence; identical to SEQ ID NO: 3022
  hemagglutinin__InfluenzaA__AEO01448

SEQ ID NO: 7531 - protein, 566 aa, Artificial Sequence; identical to SEQ ID NO: 7505
  hemagglutinin__InfluenzaA__AEO01449

SEQ ID NO: 7532 - protein, 566 aa, Artificial Sequence
  hemagglutinin__InfluenzaA__AEO01450
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSTDQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7533 - protein, 566 aa, Artificial Sequence; identical to SEQ ID NO: 2669
  hemagglutinin__InfluenzaA__AEO01451

SEQ ID NO: 7534 - protein, 566 aa, Artificial Sequence
  hemagglutinin__InfluenzaA__AEO01452
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAEAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPAHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKKLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7535 - protein, 566 aa, Artificial Sequence
  hemagglutinin__InfluenzaA__AEO01453
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGVHHPSTSADQQSLYQNADAYVFVGTSRYSKKFKREIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 7536 - protein, 566 aa, Artificial Sequence
  hemagglutinin__InfluenzaA__AEO01454
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPTTIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7537 - protein, 566 aa, Artificial Sequence
  hemagglutinin__InfluenzaA__AEO01455
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7538 - protein, 566 aa, Artificial Sequence
  hemagglutinin__InfluenzaA__AEO01456
MKAILIVLLYTFATANADTLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMDRNAGSGIIISDAPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7539 - protein, 566 aa, Artificial Sequence; identical to SEQ ID NO: 7438
  hemagglutinin__InfluenzaA__AEO01457

SEQ ID NO: 7540 - protein, 566 aa, Artificial Sequence; identical to SEQ ID NO: 7434
  hemagglutinin__InfluenzaA__AEO01458

SEQ ID NO: 7541 - protein, 566 aa, Artificial Sequence; identical to SEQ ID NO: 7434
  hemagglutinin__InfluenzaA__AEO01459

SEQ ID NO: 7542 - protein, 566 aa, Artificial Sequence; identical to SEQ ID NO: 4089
  hemagglutinin__InfluenzaA__AEO01461

SEQ ID NO: 7543 - protein, 566 aa, Artificial Sequence; identical to SEQ ID NO: 3770
  hemagglutinin__InfluenzaA__AEO01462

SEQ ID NO: 7544 - protein, 566 aa, Artificial Sequence; identical to SEQ ID NO: 3022
  hemagglutinin__InfluenzaA__AEO01463

SEQ ID NO: 7545 - protein, 566 aa, Artificial Sequence
  hemagglutinin__InfluenzaA__AEO01464
MKAILVVLLYTFATANADTLCIGYHANNSTDTVDTLLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMDRNAGSGIIISDTSVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7546 - protein, 566 aa, Artificial Sequence; identical to SEQ ID NO: 7525
  hemagglutinin__InfluenzaA__AEO01465

SEQ ID NO: 7547 - protein, 566 aa, Artificial Sequence; identical to SEQ ID NO: 4541
  hemagglutinin__InfluenzaA__AEO01466

SEQ ID NO: 7548 - protein, 566 aa, Artificial Sequence; identical to SEQ ID NO: 3022
  hemagglutinin__InfluenzaA__AEO01467

SEQ ID NO: 7549 - protein, 566 aa, Artificial Sequence; identical to SEQ ID NO: 3833
  hemagglutinin__InfluenzaA__AEO01468

SEQ ID NO: 7550 - protein, 566 aa, Artificial Sequence; identical to SEQ ID NO: 2669
  hemagglutinin__InfluenzaA__AEO01469

SEQ ID NO: 7551 - protein, 566 aa, Artificial Sequence
  hemagglutinin__InfluenzaA__AEO01470
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVIPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7552 - protein, 566 aa, Artificial Sequence; identical to SEQ ID NO: 7378
  hemagglutinin__InfluenzaA__AEO01471

SEQ ID NO: 7553 - protein, 566 aa, Artificial Sequence; identical to SEQ ID NO: 4296
  hemagglutinin__InfluenzaA__AEO01472

SEQ ID NO: 7554 - protein, 566 aa, Artificial Sequence
  hemagglutinin__InfluenzaA__AEO01473
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGECPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7555 - protein, 566 aa, Artificial Sequence
  hemagglutinin__InfluenzaA__AEO01474
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSDKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7556 - protein, 566 aa, Artificial Sequence
  hemagglutinin__InfluenzaA__AEO01475
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7557 - protein, 566 aa, Artificial Sequence
  hemagglutinin__InfluenzaA__AEO01476
MKAILVVLLYTFSTANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7558 - protein, 566 aa, Artificial Sequence
  hemagglutinin__InfluenzaA__AEO01477
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYAFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7559 - protein, 566 aa, Artificial Sequence; identical to SEQ ID NO: 3997
  hemagglutinin__InfluenzaA__AEO01478

SEQ ID NO: 7560 - protein, 566 aa, Artificial Sequence; identical to SEQ ID NO: 7387
  hemagglutinin__InfluenzaA__AEO01479

SEQ ID NO: 7561 - protein, 566 aa, Artificial Sequence; identical to SEQ ID NO: 7434
  hemagglutinin__InfluenzaA__AEO01480

SEQ ID NO: 7562 - protein, 566 aa, Artificial Sequence
  hemagglutinin__InfluenzaA__AEO01482
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCNNTCMESVKNGTYDYPKYSEEAKLNREEIDGVKLESTRIYQILAIYSTVASSLVLVVSLGAISFWMCSNGSLQCRICI

SEQ ID NO: 7563 - protein, 566 aa, Artificial Sequence
  hemagglutinin__InfluenzaA__AEO01483
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 7564 - protein, 566 aa, Artificial Sequence
  hemagglutinin__InfluenzaA__AEO01484
MKAILVVLLYTFATANADTLCIGYHANNSTDTVDTVLEKNVTVTHSVNLLEDKHNGKLCKLKGVAPLHLGKCDIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7565 - protein, 566 aa, Artificial Sequence
  hemagglutinin__InfluenzaA__AEO01485
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEITIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7566 - protein, 566 aa, Artificial Sequence
  hemagglutinin__InfluenzaA__AEO01487
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVTLESTRIYQILAIYSTVASSLVLVVSLGAISFWMCSNGSLQCRICI

SEQ ID NO: 7567 - protein, 566 aa, Artificial Sequence
  hemagglutinin__InfluenzaA__AEO01488
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFTMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDGITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7568 - protein, 566 aa, Artificial Sequence
  hemagglutinin__InfluenzaA__AEO01489
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFRPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7569 - protein, 566 aa, Artificial Sequence
  hemagglutinin__InfluenzaA__AEO01490
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRMATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7570 - protein, 566 aa, Artificial Sequence
  hemagglutinin__InfluenzaA__AEO01491
MKAILVVLLYTFATANADTLCIGYHANNSTDTVDTVLEKNVTVTHSVNLLEDKYNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYHWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7571 - protein, 566 aa, Artificial Sequence; identical to SEQ ID NO: 7438
  hemagglutinin__InfluenzaA__AEO01492

SEQ ID NO: 7572 - protein, 566 aa, Artificial Sequence
  hemagglutinin__InfluenzaA__AEO01493
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERSAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7573 - protein, 566 aa, Artificial Sequence
  hemagglutinin__InfluenzaA__AEO01494
MKAILVVLLYTFATANADTLCTGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7574 - protein, 566 aa, Artificial Sequence; identical to SEQ ID NO: 4266
  hemagglutinin__InfluenzaA__AEO01496

SEQ ID NO: 7575 - protein, 566 aa, Artificial Sequence; identical to SEQ ID NO: 3022
  hemagglutinin__InfluenzaA__AEO01497

SEQ ID NO: 7576 - protein, 566 aa, Artificial Sequence; identical to SEQ ID NO: 4266
  hemagglutinin__InfluenzaA__AEO01498

SEQ ID NO: 7577 - protein, 566 aa, Artificial Sequence
  hemagglutinin__InfluenzaA__AEO01499
MKAILVVLLYTFAIANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPYTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 7578 - protein, 566 aa, Artificial Sequence; identical to SEQ ID NO: 3770
  hemagglutinin__InfluenzaA__AEO01500

SEQ ID NO: 7579 - protein, 566 aa, Artificial Sequence; identical to SEQ ID NO: 3833
  hemagglutinin__InfluenzaA__AEO01501

SEQ ID NO: 7580 - protein, 566 aa, Artificial Sequence; identical to SEQ ID NO: 3833
  hemagglutinin__InfluenzaA__AEO01502

SEQ ID NO: 7581 - protein, 566 aa, Artificial Sequence; identical to SEQ ID NO: 4089
  hemagglutinin__InfluenzaA__AEO01503

SEQ ID NO: 7582 - protein, 566 aa, Artificial Sequence; identical to SEQ ID NO: 4266
  hemagglutinin__InfluenzaA__AEO01505

SEQ ID NO: 7583 - protein, 566 aa, Artificial Sequence; identical to SEQ ID NO: 3770
  hemagglutinin__InfluenzaA__AEO01506

SEQ ID NO: 7584 - protein, 566 aa, Artificial Sequence; identical to SEQ ID NO: 7378
  hemagglutinin__InfluenzaA__AEO01507

SEQ ID NO: 7585 - protein, 566 aa, Artificial Sequence; identical to SEQ ID NO: 4266
  hemagglutinin__InfluenzaA__AEO01508

SEQ ID NO: 7586 - protein, 566 aa, Artificial Sequence; identical to SEQ ID NO: 3997
  hemagglutinin__InfluenzaA__AEO01510

SEQ ID NO: 7587 - protein, 566 aa, Artificial Sequence
  hemagglutinin__InfluenzaA__AEO01511
MKAILVVLLYTFATANADTLCIGYHANNSTDTVDTVLEKNVTVTHSVNLLEDKHNGKLCKLRGVTPLHLGKCNIAGWILGNPECESLSTTSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7588 - protein, 566 aa, Artificial Sequence
  hemagglutinin__InfluenzaA__AEO01512
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNKCMESVKNGTYDYPKYSEEAKLNREEIDGVKLESTRIYQILAIYSTVASSLVLVVSLGAISFWMCSNGSLQCRICI

SEQ ID NO: 7589 - protein, 566 aa, Artificial Sequence
  hemagglutinin__InfluenzaA__AEO01513
MKAILAVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPVTIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7590 - protein, 566 aa, Artificial Sequence
  hemagglutinin__InfluenzaA__AEO01514
MKAILVVLLYTFATANADTLCIGYHANNSTDTVDTVLEKNVTVTHSVNLLEDMHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7591 - protein, 566 aa, Artificial Sequence; identical to SEQ ID NO: 4856
  hemagglutinin__InfluenzaA__AEO01515

SEQ ID NO: 7592 - protein, 566 aa, Artificial Sequence; identical to SEQ ID NO: 7438
  hemagglutinin__InfluenzaA__AEO01516

SEQ ID NO: 7593 - protein, 566 aa, Artificial Sequence
  hemagglutinin__InfluenzaA__AEO01517
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKENSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPEGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7594 - protein, 566 aa, Artificial Sequence
  hemagglutinin__InfluenzaA__AEO01518
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWIVKKGNSYPKLNKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7595 - protein, 566 aa, Artificial Sequence
  hemagglutinin__InfluenzaA__AEO01519
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFRPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7596 - protein, 566 aa, Artificial Sequence; identical to SEQ ID NO: 5574
  hemagglutinin__InfluenzaA__AEO01520

SEQ ID NO: 7597 - protein, 566 aa, Artificial Sequence; identical to SEQ ID NO: 4296
  hemagglutinin__InfluenzaA__AEO01521

SEQ ID NO: 7598 - protein, 566 aa, Artificial Sequence; identical to SEQ ID NO: 6088
  hemagglutinin__InfluenzaA__AEO01522

SEQ ID NO: 7599 - protein, 566 aa, Artificial Sequence; identical to SEQ ID NO: 3833
  hemagglutinin__InfluenzaA__AEO01523

SEQ ID NO: 7600 - protein, 566 aa, Artificial Sequence; identical to SEQ ID NO: 7427
  hemagglutinin__InfluenzaA__AEO01524

SEQ ID NO: 7601 - protein, 566 aa, Artificial Sequence
  hemagglutinin__InfluenzaA__AEO01525
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSGNGTCYPGDFIDYEELREQLSSVSSFERFEIFPKTSSWPNHDSNKGVTAACPHAGAKSFYKNLIWLVKKGNSYPRLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7602 - protein, 566 aa, Artificial Sequence; identical to SEQ ID NO: 3833
  hemagglutinin__InfluenzaA__AEO01526

SEQ ID NO: 7603 - protein, 566 aa, Artificial Sequence; identical to SEQ ID NO: 6610
  hemagglutinin__InfluenzaA__AEO01527

SEQ ID NO: 7604 - protein, 566 aa, Artificial Sequence
  hemagglutinin__InfluenzaA__AEO01529
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEVGNGCFEFYHKCDNTCMESVKNGTYDYPKYSEEAKLNREKIDGVKLESTRIYQILAIYSTAASSLVLVVSLGAISFWMCSNGSLQCRICI

SEQ ID NO: 7605 - protein, 566 aa, Artificial Sequence; identical to SEQ ID NO: 3833
  hemagglutinin__InfluenzaA__AEO01530

SEQ ID NO: 7606 - protein, 566 aa, Artificial Sequence
  hemagglutinin__InfluenzaA__AEO01531
MKAILVVLLYTFATANTDTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRVYQILAIYSTVASSLVLVVSLGAISFWMCSNGSLQCRICI

SEQ ID NO: 7607 - protein, 566 aa, Artificial Sequence; identical to SEQ ID NO: 7438
  hemagglutinin__InfluenzaA__AEO01532

SEQ ID NO: 7608 - protein, 566 aa, Artificial Sequence
  hemagglutinin__InfluenzaA__AEO01533
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7609 - protein, 566 aa, Artificial Sequence
  hemagglutinin__InfluenzaA__AEO01534
MKAILVVLLYTFATANADTLCIGYHANNSTDTVDTVLEKNVTVTHSVNLLEDKHNGKLCKLRGVAPLHLGKCNIAGWILGNPECESLSTARSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7610 - protein, 566 aa, Artificial Sequence; identical to SEQ ID NO: 4318
  hemagglutinin__InfluenzaA__AEO01535

SEQ ID NO: 7611 - protein, 566 aa, Artificial Sequence; identical to SEQ ID NO: 3833
  hemagglutinin__InfluenzaA__AEO01536

SEQ ID NO: 7612 - protein, 566 aa, Artificial Sequence; identical to SEQ ID NO: 5574
  hemagglutinin__InfluenzaA__AEO01537

SEQ ID NO: 7613 - protein, 566 aa, Artificial Sequence
  hemagglutinin__InfluenzaA__AEO01538
MKAILVVLLYTFATANADTLCIGYHANNSTDTVDTVLEKNVTVTHSVNLLEDKHNGKLCKLGGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7614 - protein, 566 aa, Artificial Sequence; identical to SEQ ID NO: 4296
  hemagglutinin__InfluenzaA__AEO01539

SEQ ID NO: 7615 - protein, 566 aa, Artificial Sequence
  hemagglutinin__InfluenzaA__AEO01540
MKAILVVLLYTFAIANADTLCIGYHANNSTDTVDTVLEKNVTVTHSVNLLEDKHNEKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEINGVKLESTRIYQILAIYSTVASSLVLVVSLGAISFWMCSNGSLQCRICI

SEQ ID NO: 7616 - protein, 566 aa, Artificial Sequence; identical to SEQ ID NO: 4089
  hemagglutinin__InfluenzaA__AEO01541

SEQ ID NO: 7617 - protein, 566 aa, Artificial Sequence; identical to SEQ ID NO: 3833
  hemagglutinin__InfluenzaA__AEO01542

SEQ ID NO: 7618 - protein, 566 aa, Artificial Sequence; identical to SEQ ID NO: 3770
  hemagglutinin__InfluenzaA__AEO01543

SEQ ID NO: 7619 - protein, 566 aa, Artificial Sequence; identical to SEQ ID NO: 3770
  hemagglutinin__InfluenzaA__AEO01544

SEQ ID NO: 7620 - protein, 566 aa, Artificial Sequence
  hemagglutinin__InfluenzaA__AEO01545
MKAILVVLLYTFATANADTLCIGYHANNSTDTVDTVLEKNVTVTHSVNLLEDKHSGKLCKLRGVAPLHLGKCNIAGWILGNPECESLSTASSWSYIVETSSSDNGTCYPGDFVDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7621 - protein, 566 aa, Artificial Sequence; identical to SEQ ID NO: 2656
  hemagglutinin__InfluenzaA__AEO01546

SEQ ID NO: 7622 - protein, 566 aa, Artificial Sequence; identical to SEQ ID NO: 2656
  hemagglutinin__InfluenzaA__AEO01547

SEQ ID NO: 7623 - protein, 566 aa, Artificial Sequence; identical to SEQ ID NO: 2849
  hemagglutinin__InfluenzaA__AEO01548

SEQ ID NO: 7624 - protein, 566 aa, Artificial Sequence; identical to SEQ ID NO: 2760
  hemagglutinin__InfluenzaA__AEO01549

SEQ ID NO: 7625 - protein, 566 aa, Artificial Sequence; identical to SEQ ID NO: 2669
  hemagglutinin__InfluenzaA__AEO01550

SEQ ID NO: 7626 - protein, 566 aa, Artificial Sequence; identical to SEQ ID NO: 2669
  hemagglutinin__InfluenzaA__AEO01551

SEQ ID NO: 7627 - protein, 566 aa, Artificial Sequence; identical to SEQ ID NO: 2669
  hemagglutinin__InfluenzaA__AEO01552

SEQ ID NO: 7628 - protein, 566 aa, Artificial Sequence; identical to SEQ ID NO: 2669
  hemagglutinin__InfluenzaA__AEO01553

SEQ ID NO: 7629 - protein, 566 aa, Artificial Sequence; identical to SEQ ID NO: 2669
  hemagglutinin__InfluenzaA__AEO01554

SEQ ID NO: 7630 - protein, 566 aa, Artificial Sequence; identical to SEQ ID NO: 2849
  hemagglutinin__InfluenzaA__AEO01555

SEQ ID NO: 7631 - protein, 566 aa, Artificial Sequence; identical to SEQ ID NO: 2669
  hemagglutinin__InfluenzaA__AEO01557

SEQ ID NO: 7632 - protein, 566 aa, Artificial Sequence; identical to SEQ ID NO: 2669
  hemagglutinin__InfluenzaA__AEO01558

SEQ ID NO: 7633 - protein, 566 aa, Artificial Sequence
  hemagglutinin__InfluenzaA__AEO01559
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVQDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7634 - protein, 566 aa, Artificial Sequence; identical to SEQ ID NO: 2669
  hemagglutinin__InfluenzaA__AEO01560

SEQ ID NO: 7635 - protein, 566 aa, Artificial Sequence; identical to SEQ ID NO: 2669
  hemagglutinin__InfluenzaA__AEO01561

SEQ ID NO: 7636 - protein, 566 aa, Artificial Sequence; identical to SEQ ID NO: 2669
  hemagglutinin__InfluenzaA__AEO01562

SEQ ID NO: 7637 - protein, 566 aa, Artificial Sequence; identical to SEQ ID NO: 2669
  hemagglutinin__InfluenzaA__AEO01563

SEQ ID NO: 7638 - protein, 566 aa, Artificial Sequence; identical to SEQ ID NO: 2669
  hemagglutinin__InfluenzaA__AEO01564

SEQ ID NO: 7639 - protein, 566 aa, Artificial Sequence; identical to SEQ ID NO: 2669
  hemagglutinin__InfluenzaA__AEO01565

SEQ ID NO: 7640 - protein, 566 aa, Artificial Sequence; identical to SEQ ID NO: 2656
  hemagglutinin__InfluenzaA__AEO01566

SEQ ID NO: 7641 - protein, 566 aa, Artificial Sequence; identical to SEQ ID NO: 2911
  hemagglutinin__InfluenzaA__AEO01567

SEQ ID NO: 7642 - protein, 566 aa, Artificial Sequence; identical to SEQ ID NO: 2851
  hemagglutinin__InfluenzaA__AEO01568

SEQ ID NO: 7643 - protein, 566 aa, Artificial Sequence; identical to SEQ ID NO: 2851
  hemagglutinin__InfluenzaA__AEO01569

SEQ ID NO: 7644 - protein, 566 aa, Artificial Sequence; identical to SEQ ID NO: 2911
  hemagglutinin__InfluenzaA__AEO01570

SEQ ID NO: 7645 - protein, 566 aa, Artificial Sequence; identical to SEQ ID NO: 2851
  hemagglutinin__InfluenzaA__AEO01571

SEQ ID NO: 7646 - protein, 566 aa, Artificial Sequence; identical to SEQ ID NO: 2911
  hemagglutinin__InfluenzaA__AEO01572

SEQ ID NO: 7647 - protein, 566 aa, Artificial Sequence; identical to SEQ ID NO: 2656
  hemagglutinin__InfluenzaA__AEO01573

SEQ ID NO: 7648 - protein, 566 aa, Artificial Sequence; identical to SEQ ID NO: 2669
  hemagglutinin__InfluenzaA__AEO01574

SEQ ID NO: 7649 - protein, 566 aa, Artificial Sequence; identical to SEQ ID NO: 2656
  hemagglutinin__InfluenzaA__AEO01575

SEQ ID NO: 7650 - protein, 566 aa, Artificial Sequence; identical to SEQ ID NO: 2656
  hemagglutinin__InfluenzaA__AEO01576

SEQ ID NO: 7651 - protein, 566 aa, Artificial Sequence; identical to SEQ ID NO: 2656
  hemagglutinin__InfluenzaA__AEO01577

SEQ ID NO: 7652 - protein, 566 aa, Artificial Sequence; identical to SEQ ID NO: 2911
  hemagglutinin__InfluenzaA__AEO01578

SEQ ID NO: 7653 - protein, 566 aa, Artificial Sequence; identical to SEQ ID NO: 2911
  hemagglutinin__InfluenzaA__AEO01579

SEQ ID NO: 7654 - protein, 566 aa, Artificial Sequence; identical to SEQ ID NO: 2656
  hemagglutinin__InfluenzaA__AEO01581

SEQ ID NO: 7655 - protein, 566 aa, Artificial Sequence; identical to SEQ ID NO: 2656
  hemagglutinin__InfluenzaA__AEO01582

SEQ ID NO: 7656 - protein, 566 aa, Artificial Sequence; identical to SEQ ID NO: 2656
  hemagglutinin__InfluenzaA__AEO01583

SEQ ID NO: 7657 - protein, 566 aa, Artificial Sequence; identical to SEQ ID NO: 2656
  hemagglutinin__InfluenzaA__AEO01584

SEQ ID NO: 7658 - protein, 566 aa, Artificial Sequence; identical to SEQ ID NO: 2656
  hemagglutinin__InfluenzaA__AEO01585

SEQ ID NO: 7659 - protein, 566 aa, Artificial Sequence; identical to SEQ ID NO: 2656
  hemagglutinin__InfluenzaA__AEO01586

SEQ ID NO: 7660 - protein, 566 aa, Artificial Sequence; identical to SEQ ID NO: 2656
  hemagglutinin__InfluenzaA__AEO01587

SEQ ID NO: 7661 - protein, 566 aa, Artificial Sequence; identical to SEQ ID NO: 2656
  hemagglutinin__InfluenzaA__AEO01588

SEQ ID NO: 7662 - protein, 566 aa, Artificial Sequence; identical to SEQ ID NO: 2669
  hemagglutinin__InfluenzaA__AEO01589

SEQ ID NO: 7663 - protein, 566 aa, Artificial Sequence; identical to SEQ ID NO: 2669
  hemagglutinin__InfluenzaA__AEO01590

SEQ ID NO: 7664 - protein, 566 aa, Artificial Sequence; identical to SEQ ID NO: 2669
  hemagglutinin__InfluenzaA__AEO01591

SEQ ID NO: 7665 - protein, 566 aa, Artificial Sequence; identical to SEQ ID NO: 2656
  hemagglutinin__InfluenzaA__AEO01592

SEQ ID NO: 7666 - protein, 566 aa, Artificial Sequence; identical to SEQ ID NO: 2669
  hemagglutinin__InfluenzaA__AEO01593

SEQ ID NO: 7667 - protein, 566 aa, Artificial Sequence; identical to SEQ ID NO: 2656
  hemagglutinin__InfluenzaA__AEO01594

SEQ ID NO: 7668 - protein, 566 aa, Artificial Sequence; identical to SEQ ID NO: 2656
  hemagglutinin__InfluenzaA__AEO01595

SEQ ID NO: 7669 - protein, 566 aa, Artificial Sequence; identical to SEQ ID NO: 2849
  hemagglutinin__InfluenzaA__AEO01596

SEQ ID NO: 7670 - protein, 566 aa, Artificial Sequence; identical to SEQ ID NO: 2669
  hemagglutinin__InfluenzaA__AEO01597

SEQ ID NO: 7671 - protein, 566 aa, Artificial Sequence
  hemagglutinin__InfluenzaA__AEO01598
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEMFPKTSSWPNHDSNNGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7672 - protein, 566 aa, Artificial Sequence; identical to SEQ ID NO: 2669
  hemagglutinin__InfluenzaA__AEO01599

SEQ ID NO: 7673 - protein, 566 aa, Artificial Sequence; identical to SEQ ID NO: 2669
  hemagglutinin__InfluenzaA__AEO01600

SEQ ID NO: 7674 - protein, 566 aa, Artificial Sequence; identical to SEQ ID NO: 2669
  hemagglutinin__InfluenzaA__AEO01601

SEQ ID NO: 7675 - protein, 566 aa, Artificial Sequence; identical to SEQ ID NO: 2669
  hemagglutinin__InfluenzaA__AEO01602

SEQ ID NO: 7676 - protein, 566 aa, Artificial Sequence; identical to SEQ ID NO: 2669
  hemagglutinin__InfluenzaA__AEO01603

SEQ ID NO: 7677 - protein, 566 aa, Artificial Sequence; identical to SEQ ID NO: 2669
  hemagglutinin__InfluenzaA__AEO01604

SEQ ID NO: 7678 - protein, 566 aa, Artificial Sequence; identical to SEQ ID NO: 2669
  hemagglutinin__InfluenzaA__AEO01605

SEQ ID NO: 7679 - protein, 566 aa, Artificial Sequence
  hemagglutinin__InfluenzaA__AEO01606
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7680 - protein, 566 aa, Artificial Sequence; identical to SEQ ID NO: 2911
  hemagglutinin__InfluenzaA__AEO01607

SEQ ID NO: 7681 - protein, 566 aa, Artificial Sequence; identical to SEQ ID NO: 5574
  hemagglutinin__InfluenzaA__AEO01608

SEQ ID NO: 7682 - protein, 566 aa, Artificial Sequence; identical to SEQ ID NO: 7434
  hemagglutinin__InfluenzaA__AEO01609

SEQ ID NO: 7683 - protein, 566 aa, Artificial Sequence
  hemagglutinin__InfluenzaA__AEO01610
MKAILVVLLYTFATTNADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQHAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRVCI

SEQ ID NO: 7684 - protein, 566 aa, Artificial Sequence
  hemagglutinin__InfluenzaA__AEO01611
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGREVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGECPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTAASSLVLVVSLGAISFWMCSNGSLQCRICI

SEQ ID NO: 7685 - protein, 566 aa, Artificial Sequence
  hemagglutinin__InfluenzaA__AEO01612
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGATAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7686 - protein, 566 aa, Artificial Sequence; identical to SEQ ID NO: 5266
  hemagglutinin__InfluenzaA__AEO01613

SEQ ID NO: 7687 - protein, 566 aa, Artificial Sequence
  hemagglutinin__InfluenzaA__AEO01614
MKAILVVLLYTFATANADTLCIGYHANNSTDTVDTVLEKNVTVTHSVNLLEDKHNGKLCKLKGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7688 - protein, 566 aa, Artificial Sequence
  hemagglutinin__InfluenzaA__AEO01615
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKYYINDKGKEVLVLWGIHHPSTSADQQSLYQNADAYVFVGTSRYSKKFKPEIAIRPKVREQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7689 - protein, 566 aa, Artificial Sequence; identical to SEQ ID NO: 3022
  hemagglutinin__InfluenzaA__AEO01616

SEQ ID NO: 7690 - protein, 566 aa, Artificial Sequence; identical to SEQ ID NO: 3833
  hemagglutinin__InfluenzaA__AEO01617

SEQ ID NO: 7691 - protein, 566 aa, Artificial Sequence; identical to SEQ ID NO: 4266
  hemagglutinin__InfluenzaA__AEO01619

SEQ ID NO: 7692 - protein, 566 aa, Artificial Sequence; identical to SEQ ID NO: 7378
  hemagglutinin__InfluenzaA__AEO01620

SEQ ID NO: 7693 - protein, 566 aa, Artificial Sequence; identical to SEQ ID NO: 7525
  hemagglutinin__InfluenzaA__AEO01621

SEQ ID NO: 7694 - protein, 566 aa, Artificial Sequence
  hemagglutinin__InfluenzaA__AEO01625
MKTIIALSYILCLVSAQKLPGNDNSTATLCLGHHAVPNGTIVKTITNDQIEVTNATELVQSSSTGEICDSPHQVLDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHEVYRDEALNNRFQIKGVELKSGYKDWILWISFAISCFLLCVALLGFIMWACQKGNIRCNICI

SEQ ID NO: 7695 - protein, 566 aa, Artificial Sequence
  hemagglutinin__InfluenzaA__AEO01636
MKSIIALSYILCLVSAQKLPGNDNSTATLCLGHHAVPNGTIVKTITNDQIEVTNATELVQSSSTGEICDSPHQVLDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHSKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7696 - protein, 566 aa, Artificial Sequence
  hemagglutinin__InfluenzaA__AEO01642
MKTIIALSYILCLVSAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLKFKYPALNVTMPNNEEFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSKCITPNGSIPNDKPFQNVNRVTYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7697 - protein, 565 aa, Artificial Sequence
  hemagglutinin__InfluenzaA__AEO01663
MKVKLLVLLCTFAATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLRAPRYAFALSRGFGSGIINSNAPMDKCDAKCQTPQGAINSSLPFQNVHPVPIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVRLESMGVYQILAIYSTVASSLVLLVSLGAISFWMCSNGSLQCRICI

SEQ ID NO: 7698 - protein, 565 aa, Artificial Sequence
  hemagglutinin__InfluenzaA__AEO01674
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANENLKAPRYAFALSRGFGSGIINSKAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVRLESMGVYQILAIYSTVASSLVLLVSLGAISFWMCSNGSLQCRICI

SEQ ID NO: 7699 - protein, 566 aa, Artificial Sequence; identical to SEQ ID NO: 7694
  hemagglutinin__InfluenzaA__AEO01691

SEQ ID NO: 7700 - protein, 565 aa, Artificial Sequence
  hemagglutinin__InfluenzaA__AEO01699
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKVRDQEGRINYYWTLLEPRDTIIFEANGNLIAPRYAFALSRGFGSGIINSNAPMDKCDAKCQTPQGAINSSLPFQNVHPVTIGECPKYVRSAKLRMVTGLRNIPSIPSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGAYQILAIYSTGASSLVLLVSLGAISFWMCSNGSLQRRICI

SEQ ID NO: 7701 - protein, 565 aa, Artificial Sequence
  hemagglutinin__InfluenzaA__AEO01709
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGDQKALYHTENAYVSVVSSHYSRKFTPEIAKRPKLRDQDGRINYYWTLLEPGDTTIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFELYLKCNGECMESVKNGTYDYPKYSEESKLNREKIDGVKLESMGVYQILAIYSTVASSLVLLVSLGAISFWMCSNGSLQCRICI

SEQ ID NO: 7702 - protein, 566 aa, Artificial Sequence; identical to SEQ ID NO: 3833
  hemagglutinin__InfluenzaA__AEO37530

SEQ ID NO: 7703 - protein, 566 aa, Artificial Sequence
  hemagglutinin__InfluenzaA__AEO72176
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLAVSLGAISFWMCSNGSLQCRICI

SEQ ID NO: 7704 - protein, 567 aa, Artificial Sequence
  hemagglutinin__InfluenzaA__AEO88980
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7705 - protein, 567 aa, Artificial Sequence
  hemagglutinin__InfluenzaA__AEO89021
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIPIIPKSSWSDHEASSGVSSACPYQGTPSFFRNVVWLIKKNNTYPTIKRSYNNTNQEDLLILWGIHHSNNAAEQTKLYQNPTTYISVGTSTLNLRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7706 - protein, 567 aa, Artificial Sequence
  hemagglutinin__InfluenzaA__AEO89030
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSVCPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTVLKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7707 - protein, 567 aa, Artificial Sequence
  hemagglutinin__InfluenzaA__AEO89048
MEKIVFLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVIWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAILKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7708 - protein, 567 aa, Artificial Sequence
  hemagglutinin__InfluenzaA__AEO89065
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSVCPYQGTPSFFRNVVWLIKKNNTYPTIKRSYNNTNQEDLLILWGIHHSNDAAEQTKLYQNPTTYISVGTSTLNLRLVPKIATRSKVNGQSGRMDFFWTILKPSDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7709 - protein, 567 aa, Artificial Sequence
  hemagglutinin__InfluenzaA__AEO89082
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHDTSSGVSSACPYQGTPSFFRNVVWLIKKNNTYPTIKRSYNNTNKEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7710 - protein, 567 aa, Artificial Sequence
  hemagglutinin__InfluenzaA__AEO89091
MEKTVFLLAIVSLVKSDQICIGYHANNSTEQVDTIMEKNVTVTHAQNILEKTHNGKLCDIDGVKPLILKDCSVAGWLLGNPMCDEFINVPEWSYIVEKANPANDLCYPGNFNDYEELKHLLSRINHFEKIQIIPKSSWSDHEASSGVSSTCPYQGTPSFFRNVVWLIKKNNTYPTIKRSYNNTNQEDLLILWGIHHSNDEAEQAKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVRNGTYDYPQYSEEARLKREEISGVKLESIGTYQILSIYSTVASSLALAIMMAGLSLWMCSNGSLQCRICI

SEQ ID NO: 7711 - protein, 567 aa, Artificial Sequence
  hemagglutinin__InfluenzaA__AEO89100
MEKIVPFLAIISLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKNSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGFHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDDECMESVKNGTYDYPQYSEEARLKREEISGVKLESIGTYQILSIYSTVASSLALAIMVAGLSLWMCSNGSLQCRICI

SEQ ID NO: 7712 - protein, 567 aa, Artificial Sequence
  hemagglutinin__InfluenzaA__AEO89109
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQENLLILWGIHHSNDAAEQIKLYQNPTTYISVGTSTLNQRLVTKIATRPKVNGQSGRMDFFWTILKPNDAINFESNGNFIAPEYAYKIVKEGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7713 - protein, 567 aa, Artificial Sequence
  hemagglutinin__InfluenzaA__AEO89127
MEKIVLLLAIISLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQENLLILWGIHHSNDAAEQIKLYQNPTTYISVGTSTLNQRLVPKIATRSKVNGQSGRMDFFWTILKPNDAINFESNGNFIAPEYAYKIVKEGDSAIMKSEVEYGNCNTKCQTPIGAINSSMPFHNIHPLTIGECPKYVKSNKLVLATGLRNSPLRERRRRRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGIKLESMGTYQILSIYSTVASSLALAIMVAGLSLWMCSNGSLQCRICI

SEQ ID NO: 7714 - protein, 567 aa, Artificial Sequence
  hemagglutinin__InfluenzaA__AEO89145
MEKIVLLLAIVSLVKSDQICIGYHANNSTEQVDTIMEKNVTVTHAQDILEKTHNGKLCDLDGVKPLILGDCSVAGWLLGNPMCDKFINVPEWSYIVEKANPANDLCYPGNFNDYEELKHLLSRINHFEKIQIIPKSSWSDHEASSGVSSACPYQGTPSFFRNVVWLTKKNNTYPTIKRSYNNTNQEDLLILWGIHHSNNAAEQEKLYQNPTTYISVGTSTLNQRLVPKIATRSKVNGQSGRMDFFWTILKPNDAINFESNGNFIAPEYAYKIVKKGDSAIMKSGVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTAASSLALAIMVAGLSLWMCSNGSLQCRICI

SEQ ID NO: 7715 - protein, 568 aa, Artificial Sequence
  hemagglutinin__InfluenzaA__AEO89163
MEKIVLLFAIVSLVKSDHICIGYHANNSTEQVDTIMEKNVTVTHAQDILEKTHNGKLCDLNGVKPLILKDCSVAGWLLGNPMCDEFIDVPEWSYIVEKANPANDLCYPGNFNDYEELKHLLSRINHFEKIQIIPKDSWPDHEASLGVSSACPYQGNSSFFRNVVWLIKKGNAYPTIKKSYNNTNKEDLLILWGIHHPNDEAEQTRLYQNPTTYISIGTSTLNQRLVPRIATRSKVNGQSGRIDFFWTILKPNDAINFESNGNFIAPEYAYKIVKKGDSTIMKSEVEYGNCNTRCQTPMGAINSSMPFHNIHPLTIGECPKYVKSNKLVLATGLRNSPQRERRRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLVLAIMVAGLSLWMCSNGSLQCRICI

SEQ ID NO: 7716 - protein, 567 aa, Artificial Sequence
  hemagglutinin__InfluenzaA__AEO89172
MEKIVLLLAIVSLVRSDQICIGYHANNSTEQVDTIMEKNVTVTHAQNILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLVLWGIHHSNDATEQIKLYQNPTTYVSVGTSTLNQRLVPKIATRSKVNGQSGRMDFFWTILKSNDAINFESNGNFIAPEYAYKIVKKGDSAIMKSEVEYGNCSTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7717 - protein, 567 aa, Artificial Sequence
  hemagglutinin__InfluenzaA__AEO89181
MEKIVLLFATISLVKSDHICIGYHANNSTEQVDTIMEKNVTVTHAQDILEKTHNGKLCDLNGVKPLILKDCSVAGWLLGNPMCDEFINVPEWSYIVEKANPANDLCYPGNFNDYEELKHLLSRINHFEKIQIIPKNSWSDHEASLGVSAACPYQGKSSFFRNVVWLIKKDNAYPTIKKGYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVKSNKLVLATGLRNSPQRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVRNLYDKVRLQLKDNAKELGNGCFEFYHKCDNECMESVRNGTYDYPQYSEEARLKREEISGVKLESIGIYQILSIYSTVASSLVLAIMMAGLSLWMCSNGSLQCRICI

SEQ ID NO: 7718 - protein, 567 aa, Artificial Sequence
  hemagglutinin__InfluenzaA__AEO89192
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQENLLILWGIHHSNDAAEQIKLYQNPTTYVSIGTSTLNQRLVPKIATRSKVNGQSGRMDFFWTILKPNDAINFESNGNFIAPEYAYKIVKEGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYPHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEINGVKLESIGTYQILSIYSTVASSLALAIMVAGLSLWMCSNGSLQCRICI

SEQ ID NO: 7719 - protein, 567 aa, Artificial Sequence
  hemagglutinin__InfluenzaA__AEO89203
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQENLLILWGIHHSNDAAEQIKLYQNPTTYVSIGTSTLNQRLVPKIATRSKVNGQSGRMDFFWTILKPNDAINFESNGNFIAPEYAYKIVKEGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEINGVKLESIGTYQILSIYSTVASSLALAIMVAGLSLWMCSNGSLQCRICI

SEQ ID NO: 7720 - protein, 567 aa, Artificial Sequence; identical to SEQ ID NO: 7719
  hemagglutinin__InfluenzaA__AEO89213

SEQ ID NO: 7721 - protein, 567 aa, Artificial Sequence; identical to SEQ ID NO: 7719
  hemagglutinin__InfluenzaA__AEO89224

SEQ ID NO: 7722 - protein, 567 aa, Artificial Sequence
  hemagglutinin__InfluenzaA__AEO89235
MEKIVLLLAMVSLVRSDQICIGYHANNSTEQVDTIMEKNVTVTHAQDILEKTHNGKLCDLDGVKPLILRDCSVAGWLLGNPMCDEFINVPEWSYIVEKANPANDLCYPGNLNDYEELKHLLSRINHFEKIQIIPKSSWSDHEASLGVSSACPYQGTPSFFRNVIWLIKKNNTYPTIKRSYNNTNQEDLLILWGIHHSNDEAEQIKLYQNPTTYISVGTSTLNQRLVPKIATRSKVNGQSGRMDFFWTILKPDDAINFESNGNFIAPEYAYKIVKKGDSAIMKSEVEYGNCNTKCQTPIGAINSSMPFHNIHPLTIGECPKYVKSNKLVLATGLRNSPLREKRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7723 - protein, 567 aa, Artificial Sequence
  hemagglutinin__InfluenzaA__AEO89246
MEKIVPLLAMVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNLNDYEELKHLLSRINHFEKIQIIPKSSWSDHEASLGVSSACPYQGTPSFFRNVVWLIKKNNTYPTIKRSYNNTNQEDLLILWGIHHSNDEAEQIKLYQNPTTYISVGTSTLNQRLVPKIATRSKVNGQSGRMDFFWTILKPDDAINFESNGNFIAPEYAYKIVKKGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFSNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 7724 - protein, 567 aa, Artificial Sequence
  hemagglutinin__InfluenzaA__AEO89257
MEKIVLLLAIVSLVRSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLVLWGIHHSNDAAEQIKLYQNPTTYVSVGTSTLNQRLVPKIATRSKVNGQSGRMDFFWTILKSNDAINFESNGNFIAPEYAYKIVKKGDSAIMKSEVEYGNCSTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLVLAIMVAGLSLWMCSNGSLQCRICI

SEQ ID NO: 7725 - protein, 567 aa, Artificial Sequence; identical to SEQ ID NO: 7724
  hemagglutinin__InfluenzaA__AEO89268

SEQ ID NO: 7726 - protein, 567 aa, Artificial Sequence
  hemagglutinin__InfluenzaA__AEO89279
MEKIVLLLAIVSLVKSDQICIGYHANNSTEQVDTIMEKNVTVTHAQDILEKTHNGKLCDLDGVKPLILGDCSVAGWLLGNPMCDKFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNNAAEQEKLYQNPTTYISVGTSTLNQRLVPKIATRSKVNGQSGRMDFFWTILKPNDAINFESNGNFIAPEYAYKIVKKGDSAIMKSGVKYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTAASSLALAIMVAGLSLWMCSNGSLQCRICI

SEQ ID NO: 7727 - protein, 567 aa, Artificial Sequence
  hemagglutinin__InfluenzaA__AEO89289
MEKIVLLLAIVSLAKSDQICIGYHANNSTEQVDTIMEKNVTVTHAQDILEKTHNGKLCDLDGVKPLILGDCSVAGWLLGNPMCDKFINVPEWSYIVEKVNPANDLCYPGNFNDYEELKHLLSRINHFEKIKIIPKSSWSDHEASSGVSSACPYQGTPSFFRNVVWLIKKNNTYPTIKRSYNNTNQEDLLILWGIHHSNNVAEQEKLYQNPTTYISVGTSTLNQRLVPKIATRSKVNGQSGRMDFFWTILKPNDTINFESNGNFIAPEYAYKIVKKGDSAIMKSGVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPRYSEEARLKREEISGVKLESIGTYQILSIYSTAASSLALAIMVAGLSLWMCSNGSLQCRICI

SEQ ID NO: 7728 - protein, 567 aa, Artificial Sequence
  hemagglutinin__InfluenzaA__AEO89300
MEKIVLLLAIVSLVKSDQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQENLLILWGIHHSNDAAEQIKLYQHPTTYISVGTSTLNQRLVPKIATRSKVNGQSGRMDFFWTILKPNDAINFESNGNFIAPEYAYKIVKEGDSAIMKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEINGVKLESMGTYQILSIYSTVASSLALAIMVAGLSFWMCSNGSLQCRICI

SEQ ID NO: 7729 - protein, 567 aa, Artificial Sequence
  hemagglutinin__InfluenzaA__AEO89311
MEKIVLLFAIVSLVKSDHICIGYHANNSTEQVDTIMEKNVTVTHAQDILEKTHNGKLCDLNGVKPLILKDCSVAGWLLGNPMCDEFINVPEWSYIVEKANPANDLCYPGNFNDYEELKHLLSRINHFEKIQIIPKDSWSDHEASLGVSAACPYQGNSSFFRNVVWLIKKDNAYPTIKKSYNNTNQEDLLILWGIHHPNDEAEQTRLYQNPTTYISIGTSTLNQRLVPKIATRSKVNGQSGRIDFFWTILKPNDAIHFESNGNFIAPEYAYKIVKKGDSTIMKSEVEYGNCNTRCQTPMGAINSSMPFHNIHPLTIGECPKYVKSTKLVLATGLRNSPQRERRRKRGLFGAIAGFIEGGWQGMVDGWYGYHHSNEQGSGYAADKESTQKAIDGVTNKVNSIIDKMNTQFEAVGREFNKLERRIENLNKKMEDGFLDVWTYNAELLVLMENERTLDFHDSNVKNLYDKVRLQLRDNAKELGNGCFEFYHKCNNECMESVRNGTYDYPQYSEEARLKREEISGVKLESIGIYQILSIYSTVASSLVLAIMMAGLSLWMCSNGSLQCRICI

SEQ ID NO: 7730 - protein, 566 aa, Artificial Sequence; identical to SEQ ID NO: 1928
  hemagglutinin__InfluenzaA__AEO99215

SEQ ID NO: 7731 - protein, 565 aa, Artificial Sequence
  hemagglutinin__InfluenzaA__AEQ38187
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGASASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7732 - protein, 565 aa, Artificial Sequence; identical to SEQ ID NO: 7731
  hemagglutinin__InfluenzaA__AEQ38188

SEQ ID NO: 7733 - protein, 565 aa, Artificial Sequence
  hemagglutinin__InfluenzaA__AEQ38189
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKSYANNKEKEVLVLWGVHHPPNIANQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7734 - protein, 565 aa, Artificial Sequence
  hemagglutinin__InfluenzaA__AEQ38190
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGENSFYRNLLWLTGKNGLYPNLSKPYANNKEKEVLVLWGVHHPPNIAVQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7735 - protein, 565 aa, Artificial Sequence; identical to SEQ ID NO: 3626
  hemagglutinin__InfluenzaA__AEQ38191

SEQ ID NO: 7736 - protein, 565 aa, Artificial Sequence
  hemagglutinin__InfluenzaA__AEQ38192
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISDQKTLYHTENAYVSVVSSHYSRKFTPEITKRPKVRDQEGRINYYWTLLEPGDTIIFEANGNLIAPRYAFALSRGFGSGIINSNTPMDKCDTKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7737 - protein, 565 aa, Artificial Sequence
  hemagglutinin__InfluenzaA__AEQ38193
MKVKLLILLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7738 - protein, 565 aa, Artificial Sequence
  hemagglutinin__InfluenzaA__AEQ38194
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISDQKTLYHTENAYVSVVSSHYSRKFTPEIAKRPKVRDQEGRINYYWTLLEPGDTIIFEASGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHRNEQGSGYAADQKSTQNAINGITNKVNSVIEKMNTQFTAVGKEFNKLERRMENLNKRVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7739 - protein, 565 aa, Artificial Sequence
  hemagglutinin__InfluenzaA__AEQ38195
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGASASCSHNGENSFYRNLLWLTGKNGLYPNLSKSYANNKEKEVLVLWGVHHPPNIANQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAMGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7740 - protein, 565 aa, Artificial Sequence
  hemagglutinin__InfluenzaA__AEQ38196
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGASASCSHNGENSFYRNLLWLTGKNGLYPNLSKSYANNKEKEVLVLWGVHHPPNIADQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYEYPKYSEESKLNREKIDGVKLESMGVYQILAIYSTVASSLVLLVSLGAISFWMCSNGSLQCRICI

SEQ ID NO: 7741 - protein, 565 aa, Artificial Sequence; identical to SEQ ID NO: 7731
  hemagglutinin__InfluenzaA__AEQ38197

SEQ ID NO: 7742 - protein, 565 aa, Artificial Sequence; identical to SEQ ID NO: 7731
  hemagglutinin__InfluenzaA__AEQ38198

SEQ ID NO: 7743 - protein, 566 aa, Artificial Sequence; identical to SEQ ID NO: 7050
  hemagglutinin__InfluenzaA__AEQ62909

SEQ ID NO: 7744 - protein, 566 aa, Artificial Sequence
  hemagglutinin__InfluenzaA__AEQ62910
MKAILVVMLYTFATANADTLCIGYHANNSTDTVDTVLEKNVTVTHSVNLLEDKHNGKLCKLRGVAPLHLGKCNIAGWILGNPECESLSTASSWSYIVETASPDNGTCYPGDFIDYEELREQLSSVSSFERFEIFPKTSSWPNHDSNKGVTAACPHAGAKSFYKNLMWLVKKGNSYPKLSKSYINDKGKEVLVLWGIHHPPTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQSPKGAINTSLPFQNIHPITIGECPKYVKSTKLRLATGLRNVPSVQSRGLFGAIAGFIEGGWTGMVDGWYGYHHQNEQGSGYAADLKSTQNAIDEITNKVNSVIEKMNTQFTAVGKEFNQLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7745 - protein, 566 aa, Artificial Sequence; identical to SEQ ID NO: 6867
  hemagglutinin__InfluenzaA__AEQ62911

SEQ ID NO: 7746 - protein, 566 aa, Artificial Sequence; identical to SEQ ID NO: 7050
  hemagglutinin__InfluenzaA__AEQ62912

SEQ ID NO: 7747 - protein, 566 aa, Artificial Sequence
  hemagglutinin__InfluenzaA__AEQ62915
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFINYEELREQLSSVSSFERFEIFPKTSSWPNHDSNKGVTAACPHAGAKSFYKNLIWLVKKGNSYPKLSKSYINDKGKEVLVLWGIHHPSTTADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKTNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7748 - protein, 566 aa, Artificial Sequence; identical to SEQ ID NO: 3411
  hemagglutinin__InfluenzaA__AER08646

SEQ ID NO: 7749 - protein, 566 aa, Artificial Sequence; identical to SEQ ID NO: 5419
  hemagglutinin__InfluenzaA__AER08648

SEQ ID NO: 7750 - protein, 566 aa, Artificial Sequence
  hemagglutinin__InfluenzaA__AER08652
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTAIPNIGSRPRVRNIPSRISIYWTIVKPGDILLINSTGNLIAPRGYFKIRSGKSSIMRSDAPIGKCNSECITPNGSIPSDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7751 - protein, 566 aa, Artificial Sequence; identical to SEQ ID NO: 7750
  hemagglutinin__InfluenzaA__AER08654

SEQ ID NO: 7752 - protein, 566 aa, Artificial Sequence
  hemagglutinin__InfluenzaA__AER08656
MKTIIALSYILCLVFAQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVIPNIGSRPRVRNIPSRISIYWTIVKPGDILLINSTGNLIAPRGYFKMQSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7753 - protein, 566 aa, Artificial Sequence
  hemagglutinin__InfluenzaA__AER08660
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7754 - protein, 566 aa, Artificial Sequence
  hemagglutinin__InfluenzaA__AER08664
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNSESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7755 - protein, 566 aa, Artificial Sequence; identical to SEQ ID NO: 6982
  hemagglutinin__InfluenzaA__AER08668

SEQ ID NO: 7756 - protein, 566 aa, Artificial Sequence
  hemagglutinin__InfluenzaA__AER08670
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMKSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7757 - protein, 566 aa, Artificial Sequence
  hemagglutinin__InfluenzaA__AER08672
MKTIIALSYILCLVFAQKLPGNDNSTATLCLGHHAVPNGTIVKTITNDQIEVTNATELVQSSSTGGICDSPHQILDGGNCTLIDALLGDPQCDGFQNKKWDLFVERSKAYSNCYPYDVPDYASLRSLVASSGTLEFNSESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7758 - protein, 566 aa, Artificial Sequence
  hemagglutinin__InfluenzaA__AER08674
MKTIIALSYILCLVFAQKLPGNDNSTATLCLGHHAVPNGTMVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7759 - protein, 566 aa, Artificial Sequence; identical to SEQ ID NO: 6982
  hemagglutinin__InfluenzaA__AER08676

SEQ ID NO: 7760 - protein, 566 aa, Artificial Sequence; identical to SEQ ID NO: 6982
  hemagglutinin__InfluenzaA__AER08678

SEQ ID NO: 7761 - protein, 566 aa, Artificial Sequence
  hemagglutinin__InfluenzaA__AER08680
MKTIIALSYILCLVFAQKLPGNDNSTATLCLGHHAVPNGTIVKTITNDQIEVTNATELVQSSSAGEICDSPHQILDGENCTLIDALLGDPQCDGFQNKKWDLFVERSRAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMMDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7762 - protein, 566 aa, Artificial Sequence
  hemagglutinin__InfluenzaA__AER08682
MKTVIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7763 - protein, 566 aa, Artificial Sequence
  hemagglutinin__InfluenzaA__AER08684
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7764 - protein, 566 aa, Artificial Sequence
  hemagglutinin__InfluenzaA__AER08686
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYIEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7765 - protein, 566 aa, Artificial Sequence; identical to SEQ ID NO: 6982
  hemagglutinin__InfluenzaA__AER08688

SEQ ID NO: 7766 - protein, 566 aa, Artificial Sequence
  hemagglutinin__InfluenzaA__AER08690
MKTIIALSYILCLVFAQKLPENDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSTCITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 7767 - protein, 566 aa, Artificial Sequence; identical to SEQ ID NO: 6982
  hemagglutinin__InfluenzaA__AER08692

SEQ ID NO: 7768 - protein, 566 aa, Artificial Sequence
  hemagglutinin__InfluenzaA__AER08698
MKTTIALSHILCLVFAQKLPGNDNSTATLCLGHHAVPNGTIVKTITNDQIEVTNATELVQSSSAGEICDSPHQILDGENCTLIDALLGDPQCDGFQNKKWDLFVERSRAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7769 - protein, 566 aa, Artificial Sequence; identical to SEQ ID NO: 6982
  hemagglutinin__InfluenzaA__AER08700

SEQ ID NO: 7770 - protein, 566 aa, Artificial Sequence
  hemagglutinin__InfluenzaA__AER92712
MKAILVVLLYTFATANADTLCIGYHANNSTDTVDTVLEKNVTVTHSVDLLEDKHNGKLCKLRGVAPLHLGKCNIAGWILGNPECESLSTASSWSYIVETSNSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSTDQQSLYQNADAYVFVGTSRYSKKFKPEIAIRPKVRNQEGRMNYYWTLVEPGDKITFEATGNLVVPRYAFTIERNAGSGIIISDTPIHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7771 - protein, 566 aa, Artificial Sequence; identical to SEQ ID NO: 5533
  hemagglutinin__InfluenzaA__AET10090

SEQ ID NO: 7772 - protein, 566 aa, Artificial Sequence; identical to SEQ ID NO: 5533
  hemagglutinin__InfluenzaA__AET10091

SEQ ID NO: 7773 - protein, 566 aa, Artificial Sequence; identical to SEQ ID NO: 5533
  hemagglutinin__InfluenzaA__AET10092

SEQ ID NO: 7774 - protein, 566 aa, Artificial Sequence
  hemagglutinin__InfluenzaA__AET10094
MKTIIALSCILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSSCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 7775 - protein, 566 aa, Artificial Sequence
  hemagglutinin__InfluenzaA__AET10095
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDTPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 7776 - protein, 566 aa, Artificial Sequence
  hemagglutinin__InfluenzaA__AET10096
MKTIIALSYILCLVFAQKFPGNDNSTATLCLGHHAVPNGTIVKTITNDQIEVTNATELVQNSSTGEICDSPHQIIDGENCTLIDALLGDPQCDGFQNKKWNLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7777 - protein, 566 aa, Artificial Sequence
  hemagglutinin__InfluenzaA__AET10098
MKTIIALSYILCLVFAQKFPGNDNSTATLCLGHHAVPNGTIVKTITNDQIEVTNATELVQNSSTGEICDSPHQIIDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7778 - protein, 566 aa, Artificial Sequence; identical to SEQ ID NO: 6855
  hemagglutinin__InfluenzaA__AET10099

SEQ ID NO: 7779 - protein, 566 aa, Artificial Sequence; identical to SEQ ID NO: 6982
  hemagglutinin__InfluenzaA__AET10100

SEQ ID NO: 7780 - protein, 566 aa, Artificial Sequence
  hemagglutinin__InfluenzaA__AET10101
MKTIIALSCILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGADKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 7781 - protein, 566 aa, Artificial Sequence
  hemagglutinin__InfluenzaA__AET10102
MKTIIALSYILCLVFTQKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPFDVPDYASLRSLVASSGTLEFNNESFNWTGVTQNGTSSACMRRSKSSFFSRLNWLTHLNFKYPALNVTMPNDEQFDKLYIWGVHHPGTDKDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGRTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVASLGFIMWACQKGNIRCNICI

SEQ ID NO: 7782 - protein, 566 aa, Artificial Sequence
  hemagglutinin__InfluenzaA__AET10103
MKTIIALSYILCLVFAQKLPGNDNSTATLCLGHHAVPNGTIVKTITNDQIEVTNATELVQNSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7783 - protein, 566 aa, Artificial Sequence
  hemagglutinin__InfluenzaA__AET10104
MKTIIALSYILCLVFAQKFPGNDNSTATLCLGHHAVPNGTIVKTITNDQIEVTNATELVQNSSTGEICDSPHQIIDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLGKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7784 - protein, 566 aa, Artificial Sequence
  hemagglutinin__InfluenzaA__AET10105
MKTIIALSYILCLVFAQELPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7785 - protein, 566 aa, Artificial Sequence
  hemagglutinin__InfluenzaA__AET10106
MKTIIALSYILCLVFAQKLPGNYNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7786 - protein, 566 aa, Artificial Sequence
  hemagglutinin__InfluenzaA__AET10107
MKTIIALSYILCLVFAQEIPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIKCNICI

SEQ ID NO: 7787 - protein, 566 aa, Artificial Sequence; identical to SEQ ID NO: 3411
  hemagglutinin__InfluenzaA__AET10108

SEQ ID NO: 7788 - protein, 566 aa, Artificial Sequence; identical to SEQ ID NO: 6982
  hemagglutinin__InfluenzaA__AET10109

SEQ ID NO: 7789 - protein, 566 aa, Artificial Sequence
  hemagglutinin__InfluenzaA__AET10110
MKTIIALSYILCLVFAQKLPGNDNSTATLCLGHHAVPNGTIVKTITNDQIEVTNATELVQSSSTGEICNSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIKCNICI

SEQ ID NO: 7790 - protein, 566 aa, Artificial Sequence
  hemagglutinin__InfluenzaA__AET10111
MKTIIALSYILCLVFAQEIPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLSNSTGNLIGPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7791 - protein, 566 aa, Artificial Sequence
  hemagglutinin__InfluenzaA__AET10113
MKTIIALSYILCLVFAQELPGNDNSTATLCLGHHAVQNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 7792 - protein, 566 aa, Artificial Sequence
  hemagglutinin__InfluenzaA__AET10114
MKTIIALSYILCLVFAQELPGNDDSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQASGRITVSTKRSQQAVIPNIGSRPRVRNIPSRVSIYWTIVKPGDILLINSTGNLIAPRGYFKIRSGKSSIMRSDAPIGKCNSACITPNGSISNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIMCNICI

SEQ ID NO: 7793 - protein, 565 aa, Artificial Sequence
  hemagglutinin__InfluenzaA__AET50439
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7794 - protein, 565 aa, Artificial Sequence
  hemagglutinin__InfluenzaA__AET50440
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPTHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7795 - protein, 565 aa, Artificial Sequence
  hemagglutinin__InfluenzaA__AET50441
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPTHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRGQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7796 - protein, 565 aa, Artificial Sequence
  hemagglutinin__InfluenzaA__AET50442
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGICYPGHFADYEELREQLSSVSSFERFEIFPKESSWPTHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRGQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7797 - protein, 565 aa, Artificial Sequence
  hemagglutinin__InfluenzaA__AET84163
MKVKLLVLLCTFTATYADTICIGYHANNSTDTVDTVLEKNVTVTHSVNLLENSHNGKLCLLKGIAPLQLGNCSVAGWILGNPECESLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPSISNQKTLYHTENAYVSVVSSHYSRKFTPEVAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7798 - protein, 565 aa, Artificial Sequence
  hemagglutinin__InfluenzaA__AET84174
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALIRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7799 - protein, 565 aa, Artificial Sequence
  hemagglutinin__InfluenzaA__AET84196
MKVKLLVLLCTFTATYADTICIGYHANNSTDTVDTVLEKNVTVTHSVNLLENSHNGKLCLLKGIAPLQLGNCSVAGWILGNPECESLISKESWSYIVEKPNPENGTCYPGHFADYEELREQLSSVSSFERFEIFPKESSWPNHTVTGVSASCSHNGESSFYRNLLWLTRKNGLYPTLSKSYANNKEKEVLVLWGVHHPPSINDQKTLYHTENAYVSVVSSHYSRKFTPEIAKRPKVRDQEGRINYYWTLLEPGDTIIFEANGNLIAPRYAFALSRGFGSGIINSSAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHNSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7800 - protein, 565 aa, Artificial Sequence
  hemagglutinin__InfluenzaA__AET84207
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVPSFERFEIFPKESSWPNHTVTGVSASCSHNGESSFYRNLLWLTGKNGLYPNLSKSYANNKEKEVLVLWGVHHPPSINDQKTLYHTENAYVSVVSSHYSRKFTPEIAKRPKVRDQEGRINYYWTLLEPRDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7801 - protein, 565 aa, Artificial Sequence
  hemagglutinin__InfluenzaA__AET84218
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNISNQKTLYHTENAYVSVVSSHYSRKFTPEIAKRPKVRDQEGRINYYWTLLEPGDTIIFEASGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7802 - protein, 565 aa, Artificial Sequence
  hemagglutinin__InfluenzaA__AET84229
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPTLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPPIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7803 - protein, 565 aa, Artificial Sequence
  hemagglutinin__InfluenzaA__AET84240
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGYFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 7804 - protein, 565 aa, Artificial Sequence
  hemagglutinin__InfluenzaA__AET84251
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVNQKTLYRTENAYVSVVSSHYSRKFTPEIAKRPKVRDQEGRINYYWTLLEPGDTIIFEANGNLIAPRYAFALSRGFGSGIINSNAPMGKCDAKCQTPHGAINSCLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNKEKIDGVKLESMGVYQILAIYSTVASSLVLLVSLGAISFWMCSNGSLQCRICI

SEQ ID NO: 7805 - protein, 565 aa, Artificial Sequence
  hemagglutinin__InfluenzaA__AET84262
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIVDQKTLYRTENAYVSVVSSHYSRKFTPEIAKRPKVRDQEGRINYYWTLLEPGDTIIFEANGNLIAPRYAFALSRGFGSGIINSNAPMDKCDAKCQTPHGAINSCLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7806 - protein, 565 aa, Artificial Sequence; identical to SEQ ID NO: 7733
  hemagglutinin__InfluenzaA__AET84284

SEQ ID NO: 7807 - protein, 565 aa, Artificial Sequence
  hemagglutinin__InfluenzaA__AET84306
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGNQKALYHTENAYVSVVSSHYSIKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7808 - protein, 565 aa, Artificial Sequence
  hemagglutinin__InfluenzaA__AET84339
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYRNLLWLTGKNGLYPNLSKSYANNKEKEVLVLWGVHHPPNIGNQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7809 - protein, 565 aa, Artificial Sequence; identical to SEQ ID NO: 7808
  hemagglutinin__InfluenzaA__AET84361

SEQ ID NO: 7810 - protein, 565 aa, Artificial Sequence
  hemagglutinin__InfluenzaA__AET84372
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYRNLLWLTGKNGLYPNLSKSYANNKEKEVLVLWGVHHPPNIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7811 - protein, 565 aa, Artificial Sequence
  hemagglutinin__InfluenzaA__AET84394
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYRNLLWLTGKNGLYPNLSKSYANNKEKEVLVLWGVHHPPDIGNQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSEKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7812 - protein, 565 aa, Artificial Sequence; identical to SEQ ID NO: 5516
  hemagglutinin__InfluenzaA__AET84405

SEQ ID NO: 7813 - protein, 565 aa, Artificial Sequence
  hemagglutinin__InfluenzaA__AET84416
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGERSFYRNLLWLTGKNGLYPTLSKSYANNKEKEVLVLWGVHHPPDIGDQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7814 - protein, 565 aa, Artificial Sequence
  hemagglutinin__InfluenzaA__AET84427
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGNQKTLYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7815 - protein, 565 aa, Artificial Sequence
  hemagglutinin__InfluenzaA__AET84438
MKVKLLVLLCTFTATYADTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGVQKTLYNTENAYVSVVSSHYSRKFTPEIAKRPKVRDQEGRINYYWTLLEPGDTIMFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7816 - protein, 565 aa, Artificial Sequence
  hemagglutinin__InfluenzaA__AET84449
MKVKLLVLLCTFTATYADTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHTENAYVSVVSSHYSRKFTPEIAKRPKVRDQEGRINYYWTLLEPGDTIIFEANGNLIAPRYAFALSRGFGSGIINSNAPMDGCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 7817 - protein, 566 aa, Artificial Sequence
  hemagglutinin__InfluenzaA__AET98600
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFNWTGVTQNGTSSACIRRSNNSFFSRLNWLTHLNFKYPALNVTVPNNEQFDKLYIWGVHHPGTDKDQIFLYAQASGRITVSTKRSQQAVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFTIYHKCDNACIGSIRNGTYDHNVYRDEALNNRFQIKGVELKSGYKDWILWISFAISCFLLCVALLGFIMWACQKGNIRCNICI

SEQ ID NO: 7818 - protein, 566 aa, Artificial Sequence
  hemagglutinin__InfluenzaA__AEV76874
MKAILVVLLYTFATANADTLCIGYHANNSTDTVDTVLEKNVTVTHSVNLLEDKHNGKLCKLRGVAPLHLGKCNIAGWILGNPECESFSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFNPEIEIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7819 - protein, 566 aa, Artificial Sequence; identical to SEQ ID NO: 2669
  hemagglutinin__InfluenzaA__AEW10574

SEQ ID NO: 7820 - protein, 566 aa, Artificial Sequence; identical to SEQ ID NO: 2669
  hemagglutinin__InfluenzaA__AEW10584

SEQ ID NO: 7821 - protein, 566 aa, Artificial Sequence; identical to SEQ ID NO: 3022
  hemagglutinin__InfluenzaA__AEW10594

SEQ ID NO: 7822 - protein, 566 aa, Artificial Sequence; identical to SEQ ID NO: 3022
  hemagglutinin__InfluenzaA__AEW10604

SEQ ID NO: 7823 - protein, 566 aa, Artificial Sequence; identical to SEQ ID NO: 3022
  hemagglutinin__InfluenzaA__AEW10614

SEQ ID NO: 7824 - protein, 566 aa, Artificial Sequence; identical to SEQ ID NO: 3022
  hemagglutinin__InfluenzaA__AEW10624

SEQ ID NO: 7825 - protein, 566 aa, Artificial Sequence; identical to SEQ ID NO: 2669
  hemagglutinin__InfluenzaA__AEW10634

SEQ ID NO: 7826 - protein, 566 aa, Artificial Sequence; identical to SEQ ID NO: 2656
  hemagglutinin__InfluenzaA__AEW10644

SEQ ID NO: 7827 - protein, 566 aa, Artificial Sequence
  hemagglutinin__InfluenzaA__AEW10654
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLNKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7828 - protein, 566 aa, Artificial Sequence; identical to SEQ ID NO: 2656
  hemagglutinin__InfluenzaA__AEW10664

SEQ ID NO: 7829 - protein, 566 aa, Artificial Sequence
  hemagglutinin__InfluenzaA__AEW10674
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAEAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7830 - protein, 566 aa, Artificial Sequence; identical to SEQ ID NO: 2669
  hemagglutinin__InfluenzaA__AEW10684

SEQ ID NO: 7831 - protein, 566 aa, Artificial Sequence; identical to SEQ ID NO: 2656
  hemagglutinin__InfluenzaA__AEW10694

SEQ ID NO: 7832 - protein, 566 aa, Artificial Sequence; identical to SEQ ID NO: 2656
  hemagglutinin__InfluenzaA__AEW10704

SEQ ID NO: 7833 - protein, 566 aa, Artificial Sequence; identical to SEQ ID NO: 7827
  hemagglutinin__InfluenzaA__AEW10724

SEQ ID NO: 7834 - protein, 566 aa, Artificial Sequence; identical to SEQ ID NO: 2669
  hemagglutinin__InfluenzaA__AEW10734

SEQ ID NO: 7835 - protein, 566 aa, Artificial Sequence
  hemagglutinin__InfluenzaA__AEW10744
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSILSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7836 - protein, 566 aa, Artificial Sequence; identical to SEQ ID NO: 7835
  hemagglutinin__InfluenzaA__AEW10754

SEQ ID NO: 7837 - protein, 566 aa, Artificial Sequence
  hemagglutinin__InfluenzaA__AEW10764
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNANAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7838 - protein, 566 aa, Artificial Sequence; identical to SEQ ID NO: 2913
  hemagglutinin__InfluenzaA__AEW10774

SEQ ID NO: 7839 - protein, 566 aa, Artificial Sequence; identical to SEQ ID NO: 2656
  hemagglutinin__InfluenzaA__AEW10784

SEQ ID NO: 7840 - protein, 566 aa, Artificial Sequence; identical to SEQ ID NO: 2656
  hemagglutinin__InfluenzaA__AEW10794

SEQ ID NO: 7841 - protein, 566 aa, Artificial Sequence; identical to SEQ ID NO: 2849
  hemagglutinin__InfluenzaA__AEW10804

SEQ ID NO: 7842 - protein, 566 aa, Artificial Sequence; identical to SEQ ID NO: 2667
  hemagglutinin__InfluenzaA__AEW10814

SEQ ID NO: 7843 - protein, 566 aa, Artificial Sequence; identical to SEQ ID NO: 2760
  hemagglutinin__InfluenzaA__AEW10824

SEQ ID NO: 7844 - protein, 566 aa, Artificial Sequence; identical to SEQ ID NO: 2656
  hemagglutinin__InfluenzaA__AEW10834

SEQ ID NO: 7845 - protein, 566 aa, Artificial Sequence; identical to SEQ ID NO: 2849
  hemagglutinin__InfluenzaA__AEW10844

SEQ ID NO: 7846 - protein, 566 aa, Artificial Sequence
  hemagglutinin__InfluenzaA__AEW10854
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEITIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7847 - protein, 566 aa, Artificial Sequence; identical to SEQ ID NO: 2849
  hemagglutinin__InfluenzaA__AEW10864

SEQ ID NO: 7848 - protein, 566 aa, Artificial Sequence; identical to SEQ ID NO: 2849
  hemagglutinin__InfluenzaA__AEW10874

SEQ ID NO: 7849 - protein, 566 aa, Artificial Sequence; identical to SEQ ID NO: 2849
  hemagglutinin__InfluenzaA__AEW10884

SEQ ID NO: 7850 - protein, 566 aa, Artificial Sequence; identical to SEQ ID NO: 2656
  hemagglutinin__InfluenzaA__AEW10894

SEQ ID NO: 7851 - protein, 566 aa, Artificial Sequence; identical to SEQ ID NO: 2849
  hemagglutinin__InfluenzaA__AEW10904

SEQ ID NO: 7852 - protein, 566 aa, Artificial Sequence; identical to SEQ ID NO: 2849
  hemagglutinin__InfluenzaA__AEW10914

SEQ ID NO: 7853 - protein, 566 aa, Artificial Sequence; identical to SEQ ID NO: 2656
  hemagglutinin__InfluenzaA__AEW10924

SEQ ID NO: 7854 - protein, 566 aa, Artificial Sequence; identical to SEQ ID NO: 2656
  hemagglutinin__InfluenzaA__AEW10934

SEQ ID NO: 7855 - protein, 566 aa, Artificial Sequence; identical to SEQ ID NO: 2849
  hemagglutinin__InfluenzaA__AEW10944

SEQ ID NO: 7856 - protein, 566 aa, Artificial Sequence; identical to SEQ ID NO: 2669
  hemagglutinin__InfluenzaA__AEW10954

SEQ ID NO: 7857 - protein, 566 aa, Artificial Sequence; identical to SEQ ID NO: 2669
  hemagglutinin__InfluenzaA__AEW10964

SEQ ID NO: 7858 - protein, 566 aa, Artificial Sequence; identical to SEQ ID NO: 2849
  hemagglutinin__InfluenzaA__AEW10974

SEQ ID NO: 7859 - protein, 566 aa, Artificial Sequence; identical to SEQ ID NO: 2669
  hemagglutinin__InfluenzaA__AEW10984

SEQ ID NO: 7860 - protein, 566 aa, Artificial Sequence; identical to SEQ ID NO: 2669
  hemagglutinin__InfluenzaA__AEW10994

SEQ ID NO: 7861 - protein, 566 aa, Artificial Sequence; identical to SEQ ID NO: 2669
  hemagglutinin__InfluenzaA__AEW11004

SEQ ID NO: 7862 - protein, 566 aa, Artificial Sequence; identical to SEQ ID NO: 2669
  hemagglutinin__InfluenzaA__AEW11014

SEQ ID NO: 7863 - protein, 566 aa, Artificial Sequence; identical to SEQ ID NO: 2669
  hemagglutinin__InfluenzaA__AEW11024

SEQ ID NO: 7864 - protein, 566 aa, Artificial Sequence; identical to SEQ ID NO: 2669
  hemagglutinin__InfluenzaA__AEW11034

SEQ ID NO: 7865 - protein, 566 aa, Artificial Sequence; identical to SEQ ID NO: 2849
  hemagglutinin__InfluenzaA__AEW11044

SEQ ID NO: 7866 - protein, 566 aa, Artificial Sequence; identical to SEQ ID NO: 2669
  hemagglutinin__InfluenzaA__AEW11054

SEQ ID NO: 7867 - protein, 566 aa, Artificial Sequence; identical to SEQ ID NO: 2656
  hemagglutinin__InfluenzaA__AEW11064

SEQ ID NO: 7868 - protein, 566 aa, Artificial Sequence; identical to SEQ ID NO: 2656
  hemagglutinin__InfluenzaA__AEW11074

SEQ ID NO: 7869 - protein, 566 aa, Artificial Sequence
  hemagglutinin__InfluenzaA__AEW11084
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACLHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7870 - protein, 566 aa, Artificial Sequence; identical to SEQ ID NO: 2656
  hemagglutinin__InfluenzaA__AEW11094

SEQ ID NO: 7871 - protein, 566 aa, Artificial Sequence; identical to SEQ ID NO: 2656
  hemagglutinin__InfluenzaA__AEW11104

SEQ ID NO: 7872 - protein, 566 aa, Artificial Sequence; identical to SEQ ID NO: 2669
  hemagglutinin__InfluenzaA__AEW11114

SEQ ID NO: 7873 - protein, 566 aa, Artificial Sequence
  hemagglutinin__InfluenzaA__AEW11124
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKFVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7874 - protein, 566 aa, Artificial Sequence
  hemagglutinin__InfluenzaA__AEW11134
MKAILVVLLYTFATANADTLCIGYHANNSTDTVDTVLEKNVTVTHSVNILEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNKEEIDGVKLESTRIYQILAIYSTVASSLVLVVSLGAISFWMCSNGSLQCRICI

SEQ ID NO: 7875 - protein, 566 aa, Artificial Sequence; identical to SEQ ID NO: 2669
  hemagglutinin__InfluenzaA__AEW11144

SEQ ID NO: 7876 - protein, 566 aa, Artificial Sequence; identical to SEQ ID NO: 2669
  hemagglutinin__InfluenzaA__AEW11154

SEQ ID NO: 7877 - protein, 566 aa, Artificial Sequence; identical to SEQ ID NO: 7869
  hemagglutinin__InfluenzaA__AEW11164

SEQ ID NO: 7878 - protein, 566 aa, Artificial Sequence; identical to SEQ ID NO: 7869
  hemagglutinin__InfluenzaA__AEW11174

SEQ ID NO: 7879 - protein, 566 aa, Artificial Sequence; identical to SEQ ID NO: 2669
  hemagglutinin__InfluenzaA__AEW11184

SEQ ID NO: 7880 - protein, 566 aa, Artificial Sequence; identical to SEQ ID NO: 2656
  hemagglutinin__InfluenzaA__AEW11194

SEQ ID NO: 7881 - protein, 566 aa, Artificial Sequence; identical to SEQ ID NO: 2669
  hemagglutinin__InfluenzaA__AEW11204

SEQ ID NO: 7882 - protein, 566 aa, Artificial Sequence; identical to SEQ ID NO: 2669
  hemagglutinin__InfluenzaA__AEW11214

SEQ ID NO: 7883 - protein, 566 aa, Artificial Sequence; identical to SEQ ID NO: 2849
  hemagglutinin__InfluenzaA__AEW11224

SEQ ID NO: 7884 - protein, 566 aa, Artificial Sequence; identical to SEQ ID NO: 2669
  hemagglutinin__InfluenzaA__AEW11234

SEQ ID NO: 7885 - protein, 566 aa, Artificial Sequence; identical to SEQ ID NO: 2669
  hemagglutinin__InfluenzaA__AEW11244

SEQ ID NO: 7886 - protein, 566 aa, Artificial Sequence
  hemagglutinin__InfluenzaA__AEW11254
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACLHAGAKSFYKNLIWLVKKGNSYPKLSKSYINDKGKEVLVLWGIHHPSASADQQSLYQNADAYVFVGSSRYSKKVKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7887 - protein, 566 aa, Artificial Sequence; identical to SEQ ID NO: 2656
  hemagglutinin__InfluenzaA__AEW11263

SEQ ID NO: 7888 - protein, 566 aa, Artificial Sequence; identical to SEQ ID NO: 2656
  hemagglutinin__InfluenzaA__AEW11273

SEQ ID NO: 7889 - protein, 566 aa, Artificial Sequence; identical to SEQ ID NO: 2656
  hemagglutinin__InfluenzaA__AEW11283

SEQ ID NO: 7890 - protein, 566 aa, Artificial Sequence; identical to SEQ ID NO: 2656
  hemagglutinin__InfluenzaA__AEW11293

SEQ ID NO: 7891 - protein, 566 aa, Artificial Sequence
  hemagglutinin__InfluenzaA__AEW11303
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRVCI

SEQ ID NO: 7892 - protein, 566 aa, Artificial Sequence; identical to SEQ ID NO: 2656
  hemagglutinin__InfluenzaA__AEW11313

SEQ ID NO: 7893 - protein, 566 aa, Artificial Sequence
  hemagglutinin__InfluenzaA__AEW11323
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRGQEGRMNYYWTLVEPGDKITFEATGNLVVPRYAFAMERNAGSGIIISDTPVHDCNTTCQTPKGAVNTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7894 - protein, 566 aa, Artificial Sequence
  hemagglutinin__InfluenzaA__AEW22712
MKAILVVLLYTFATANADTLCIGYHANNSTDTIDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7895 - protein, 566 aa, Artificial Sequence
  hemagglutinin__InfluenzaA__AEW22718
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVKPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7896 - protein, 566 aa, Artificial Sequence; identical to SEQ ID NO: 6454
  hemagglutinin__InfluenzaA__AEW22720

SEQ ID NO: 7897 - protein, 566 aa, Artificial Sequence; identical to SEQ ID NO: 6454
  hemagglutinin__InfluenzaA__AEW22722

SEQ ID NO: 7898 - protein, 566 aa, Artificial Sequence
  hemagglutinin__InfluenzaA__AEW22724
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKGFYKNLIWLVKKGNSYPKLSKSYINDKGKEVLVLWGIHHPSTTADQQSLYQNADTYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRNQLKNNAREIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7899 - protein, 566 aa, Artificial Sequence
  hemagglutinin__InfluenzaA__AEW25297
MKAILVVLLYTFATANADTLCIGYHANNSTDTVDTVLEKNVTVTHSVNLLEDKHNGKLCKLRGVAPLHLGKCNIAGWIPGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPRGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7900 - protein, 566 aa, Artificial Sequence; identical to SEQ ID NO: 3467
  hemagglutinin__InfluenzaA__AEW25306

SEQ ID NO: 7901 - protein, 566 aa, Artificial Sequence
  hemagglutinin__InfluenzaA__AEW25315
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWVCSNGSLQCRICI

SEQ ID NO: 7902 - protein, 566 aa, Artificial Sequence
  hemagglutinin__InfluenzaA__AEW25331
MKAILVVLLYTFATANADTLCIGYHANNSTDTVDTVLEKNVTVTHSVNLLEDKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIPPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7903 - protein, 566 aa, Artificial Sequence
  hemagglutinin__InfluenzaA__AEW25349
MKAILVVLLYTFATANADTLCIGYHANNSTDTVDTVLEKNVTVTHSVNLLEDKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7904 - protein, 566 aa, Artificial Sequence
  hemagglutinin__InfluenzaA__AEW25367
MKAILVVLLYTFATANADTLCIGYHANNSTDTVDTVLEKNVTVTHSVNLLEDKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQRLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYTADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7905 - protein, 566 aa, Artificial Sequence
  hemagglutinin__InfluenzaA__AEW25377
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTTACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVKSQLKNNAKEIGNGCFEFYHKCDNACMESVKNGTYDYPKYSEEAKLNREEIDGVKLESTRIYQILAIYSTVASSLVLVVSLGAISFWMCSNGSLQCRICI

SEQ ID NO: 7906 - protein, 566 aa, Artificial Sequence
  hemagglutinin__InfluenzaA__AEW25385
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVPSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7907 - protein, 566 aa, Artificial Sequence; identical to SEQ ID NO: 7903
  hemagglutinin__InfluenzaA__AEW25416

SEQ ID NO: 7908 - protein, 566 aa, Artificial Sequence
  hemagglutinin__InfluenzaA__AEW25446
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNKQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7909 - protein, 566 aa, Artificial Sequence; identical to SEQ ID NO: 7903
  hemagglutinin__InfluenzaA__AEW25454

SEQ ID NO: 7910 - protein, 566 aa, Artificial Sequence
  hemagglutinin__InfluenzaA__AEW25462
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKPYTNDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7911 - protein, 566 aa, Artificial Sequence; identical to SEQ ID NO: 3467
  hemagglutinin__InfluenzaA__AEW25472

SEQ ID NO: 7912 - protein, 566 aa, Artificial Sequence
  hemagglutinin__InfluenzaA__AEW25482
MKAILVVLLYTFATANADTLCIGYHANNSTDTVDTVLEKKVTVTHSVNLLEDKHNGKLCKLRGVAPLHLGKCNIAGWILGNPECESLSTASSWSYIVETSNSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQGGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFELYHKCDNTCMESVKNGTYDYPKYSEEAKLNREEIDGVKLESTRIYQILAIYSTVASSLVLVVSLGAISFWMCSNGSLQCRICI

SEQ ID NO: 7913 - protein, 566 aa, Artificial Sequence
  hemagglutinin__InfluenzaA__AEW25492
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYIFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7914 - protein, 566 aa, Artificial Sequence
  hemagglutinin__InfluenzaA__AEW25501
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGAKSFYKNLICLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7915 - protein, 566 aa, Artificial Sequence; identical to SEQ ID NO: 7903
  hemagglutinin__InfluenzaA__AEW25509

SEQ ID NO: 7916 - protein, 566 aa, Artificial Sequence
  hemagglutinin__InfluenzaA__AEW25519
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHTGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREKIDGVKLESTRIYQILAIYSTVASSLVLVVSLGAISFWMCSNGSLQCRICI

SEQ ID NO: 7917 - protein, 566 aa, Artificial Sequence
  hemagglutinin__InfluenzaA__AEW25528
MKAILVVLLYTFATANADTLCIGYHANNSTDTVDTVLEKNVTVTHSVNLLEDKHNGKLCKLRGVAPLHLGKCNIAGWILGNPECESFSTSSSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQERRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7918 - protein, 566 aa, Artificial Sequence
  hemagglutinin__InfluenzaA__AEW25545
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGSYDYPKYSEEAKLNREEIDGVKLESTRIYQILAIYSTVASSLVMVVSLGAISFWMCSNGSLQCRICI

SEQ ID NO: 7919 - protein, 566 aa, Artificial Sequence
  hemagglutinin__InfluenzaA__AEW25555
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHYCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7920 - protein, 566 aa, Artificial Sequence
  hemagglutinin__InfluenzaA__AEW25564
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGALNTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNRKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTGIYQILAIYSTVASSLVLVVSLGAISFWMCSNGSLQCRICI

SEQ ID NO: 7921 - protein, 566 aa, Artificial Sequence; identical to SEQ ID NO: 3467
  hemagglutinin__InfluenzaA__AEW25573

SEQ ID NO: 7922 - protein, 566 aa, Artificial Sequence
  hemagglutinin__InfluenzaA__AEW25582
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIILSDTPVHDCNTTCQTPKGAINTSLPFQNIHPITIGKCPKYVKSTKLRLATGLRNVPSIQSRGLFGAIAGFIEGGWTGMVDGWYGYHHQNGQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7923 - protein, 566 aa, Artificial Sequence
  hemagglutinin__InfluenzaA__AEW25590
MKAILVVLLYTFATANADTLCIGYHANNSTDTVDTVLEKNVTVTQSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEARMNYYWTLVEPGDKITFEATGNLVVPRYAFAMERDAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLHEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7924 - protein, 566 aa, Artificial Sequence; identical to SEQ ID NO: 3467
  hemagglutinin__InfluenzaA__AEW25600

SEQ ID NO: 7925 - protein, 566 aa, Artificial Sequence; identical to SEQ ID NO: 3467
  hemagglutinin__InfluenzaA__AEW25620

SEQ ID NO: 7926 - protein, 566 aa, Artificial Sequence
  hemagglutinin__InfluenzaA__AEW25629
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAEAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNMCMESVKNGTYDYPKYSEEAKLNREEIDGVKLESTRIYQILAIYSTVASSLVLVVSLGAISFWMCSNGSLQCRICI

SEQ ID NO: 7927 - protein, 566 aa, Artificial Sequence; identical to SEQ ID NO: 2669
  hemagglutinin__InfluenzaA__AEW25637

SEQ ID NO: 7928 - protein, 566 aa, Artificial Sequence
  hemagglutinin__InfluenzaA__AEW25646
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7929 - protein, 566 aa, Artificial Sequence
  hemagglutinin__InfluenzaA__AEW25654
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSPPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7930 - protein, 566 aa, Artificial Sequence
  hemagglutinin__InfluenzaA__AEW25662
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGITAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7931 - protein, 566 aa, Artificial Sequence
  hemagglutinin__InfluenzaA__AEW25669
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVEGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7932 - protein, 566 aa, Artificial Sequence
  hemagglutinin__InfluenzaA__AEW25678
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFEKFEIFPKTSSWPNHDSNKGVTAACPHAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLRAISFWMCSNGSLQCRICI

SEQ ID NO: 7933 - protein, 566 aa, Artificial Sequence
  hemagglutinin__InfluenzaA__AEW25687
MKAILVVLLYTFATANADTLCIGYHANNSTDTVDTVLEKNVTVTHSVNLLEDKHNGKLCKLRGVAPLHLGKCNIAGWILGNPECESLSTASSWSYIVETSSSDNGTCYPGDFIDYEELREQLSSVSSFERFEIFPKTSSWPNHDPNKGVTAACPYAGAKSFYKNLIWLVKKGNSYPKLSKSYINDKGKEVLVLWGIHHPSTSADQQSLYQNADAYVFVGTSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNVPSIQSRGLFGAIAGFIEGGWTGMVDGWYGYHHQNEQGSGYAADLKSTQNAIDKITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGVKLESTRIYQILAIYSTVASSLVLVVSLGAISFWMCSNGSLQCRICI

SEQ ID NO: 7934 - protein, 566 aa, Artificial Sequence; identical to SEQ ID NO: 7903
  hemagglutinin__InfluenzaA__AEW25696

SEQ ID NO: 7935 - protein, 566 aa, Artificial Sequence; identical to SEQ ID NO: 3467
  hemagglutinin__InfluenzaA__AEW25706

SEQ ID NO: 7936 - protein, 564 aa, Artificial Sequence
  hemagglutinin__InfluenzaA__AEW91908
MEKIVLLFATISLVKSDHICIGYHANNSTEQVDTIMEKNVTVTHAQDILEKTHNGKLCDLNGVKPLILKDCSVAGWLLGNPMCDEFINVPEWSYIVEKANPANDLCYPGNFNDYEELKHLLSRINHFEKIQIIPKNSWSDHEASLGVSAACPYQGKSSFFRNVVWLIKKDNAYPTIKKGYNNTNQEDLLVLWGIHHPNDEAEQTRLYQNPTTYISIGTSTLNQRLVPKIATRSKINGQSGRIDFFWTILKPNDAIHFESNGNFIAPEYAYKIVKKGDSTIMKSEVEYGNCNTRCQTPIGAINSSMPFHNIHPLTIGECPKYVKSNKLVLATGLRNSPQGETRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVRNLYDKVRLQLKDNAKELGNGCFEFYHKCDNECMESVRNGTYDYPQYSEEARLKREEISGVKLESIGIYQILSIYSTVASSLVLAIMMAGLSLWMCSNGSLQCRICI
